United States Patent 10,988,754 (NUCLEIC ACID MOLECULES) - sequence listing, part 4

SEQ ID NO: 68305 - RNA, 30 nt, Artificial Sequence
  Adenylate kinase isoenzyme 5 (224-233)
uuccugaucgacggcuaccccagagaggug

SEQ ID NO: 68306 - RNA, 27 nt, Artificial Sequence
  BTB/POZ domain-containing protein KCTD9 (136-144)
uuccugaucgacagaagccccgaguac

SEQ ID NO: 68307 - RNA, 30 nt, Artificial Sequence; identical to SEQ ID NO: 44080
  Tensin-2 (1202-1211)

SEQ ID NO: 68308 - RNA, 27 nt, Artificial Sequence
  Protein phosphatase 1 regulatory subunit 12A (37-45)
uuccugaucggccagggggcccacgug

SEQ ID NO: 68309 - RNA, 27 nt, Artificial Sequence
  Proline-rich protein 12 (641-649)
uuccugauccagcaccuccuucaagcc

SEQ ID NO: 68310 - RNA, 33 nt, Artificial Sequence
  Protein FAM73A (567-577)
uuccugaaggacaucuuugauuucgagaaagug

SEQ ID NO: 68311 - RNA, 27 nt, Artificial Sequence
  Catenin alpha-1 (85-93)
uuccugaaggaggaacucguggccgcu

SEQ ID NO: 68312 - RNA, 27 nt, Artificial Sequence
  Threonylcarbamoyladenosine tRNA methylthiotransferase (278-286)
uuccugaaggagaaagugcccggcauc

SEQ ID NO: 68313 - RNA, 27 nt, Artificial Sequence
  Ankyrin-3 (171-179)
uuccugcucgaccacggcgccagccuu

SEQ ID NO: 68314 - RNA, 30 nt, Artificial Sequence
  DNA-binding protein RFX7 (684-693)
uuccugcucgacagcgauuccaagucugug

SEQ ID NO: 68315 - RNA, 30 nt, Artificial Sequence
  Protein TANC2 (96-105)
uuccugcucggcgagaaggugaccgaaguc

SEQ ID NO: 68316 - RNA, 27 nt, Artificial Sequence
  Transmembrane emp24 domain-containing protein 10 (22-30)
uuccugcucggccccagacuugugcug

SEQ ID NO: 68317 - RNA, 27 nt, Artificial Sequence
  TBC1 domain family member 8B (190-198)
uuccugcucggcagcgagaucaagcuu

SEQ ID NO: 68318 - RNA, 27 nt, Artificial Sequence
  Intraflagellar transport protein 56 (385-393)
uuccugcucauccagagcgagaagaug

SEQ ID NO: 68319 - RNA, 30 nt, Artificial Sequence
  Peptidyl-prolyl cis-trans isomerase B (15-24)
uuccugcuccuucccggcccuagcgccgcu

SEQ ID NO: 68320 - RNA, 27 nt, Artificial Sequence
  G-protein coupled receptor 56 (460-468)
uuccugcucagcgagcccguggcccuu

SEQ ID NO: 68321 - RNA, 27 nt, Artificial Sequence
  Huntingtin (694-702)
uuccugcucaccggcgggaagaacgug

SEQ ID NO: 68322 - RNA, 36 nt, Artificial Sequence; identical to SEQ ID NO: 44095
  Protocadherin Fat 3 (2442-2453)

SEQ ID NO: 68323 - RNA, 27 nt, Artificial Sequence
  Cortactin-binding protein 2 (1244-1252)
uuccugaugggcaccaucgccaaggcu

SEQ ID NO: 68324 - RNA, 33 nt, Artificial Sequence
  5,6-dihydroxyindole-2-carboxylic acid oxidase (383-393)
uuccugaacggcaccgggggacagacacaccuc

SEQ ID NO: 68325 - RNA, 27 nt, Artificial Sequence
  Multidrug and toxin extrusion protein 1 (134-142)
uuccugaacacccagcacauccuccuu

SEQ ID NO: 68326 - RNA, 27 nt, Artificial Sequence
  Peroxisome biogenesis factor 1 (613-621)
uuccugcccgccagccucagauccgug

SEQ ID NO: 68327 - RNA, 27 nt, Artificial Sequence
  Paired amphipathic helix protein Sin3a (379-387)
uuccugcccgacgccaacagcuccgug

SEQ ID NO: 68328 - RNA, 36 nt, Artificial Sequence
  Eukaryotic translation initiation factor 4 gamma 1 (1367-1378)
uuccugcccgagggccaggacaucggggccuuugug

SEQ ID NO: 68329 - RNA, 27 nt, Artificial Sequence
  NADH dehydrogenase (ubiquinone) 1 alpha subcomplex subunit 9, mitochondrial (286-294)
uuccugcccuuuccucucccacuuuuc

SEQ ID NO: 68330 - RNA, 27 nt, Artificial Sequence
  Mitochondrial dynamics protein MID51 (470-478)
uuccugcccagacaggcccuccuuuuu

SEQ ID NO: 68331 - RNA, 30 nt, Artificial Sequence; identical to SEQ ID NO: 44104
  Ubiquitin carboxyl-terminal hydrolase 19 (742-751)

SEQ ID NO: 68332 - RNA, 27 nt, Artificial Sequence
  Peroxisomal acyl-coenzyme A oxidase 1 (107-115)
uuccugcccacccuccuucaccaggcc

SEQ ID NO: 68333 - RNA, 30 nt, Artificial Sequence
  ATP-binding cassette sub-family C member 11 (455-464)
uuccugcaggagagccccguguuuuacguc

SEQ ID NO: 68334 - RNA, 27 nt, Artificial Sequence
  Hemicentin-1 (2534-2542)
uuccugcagaucaccaacgugcaaguc

SEQ ID NO: 68335 - RNA, 27 nt, Artificial Sequence
  Protocadherin gamma-A12 (749-757)
uuccugcagaccuacagccacgaggug

SEQ ID NO: 68336 - RNA, 27 nt, Artificial Sequence
  Melanocyte protein PMEL (239-247)
uuccugagaaaccagccccucaccuuu

SEQ ID NO: 68337 - RNA, 33 nt, Artificial Sequence
  Hemoglobin subunit alpha (5-15)
uuccugagcuuucccaccacaaagacuuacuuc

SEQ ID NO: 68338 - RNA, 27 nt, Artificial Sequence
  Insulin receptor substrate 2 (1325-1333)
uuccugagccaccaucucaaggaggcc

SEQ ID NO: 68339 - RNA, 27 nt, Artificial Sequence
  Tensin-3 (1065-1073)
uuccugagccacaacuuucucaccgug

SEQ ID NO: 68340 - RNA, 27 nt, Artificial Sequence
  Protein capicua homolog (1061-1069)
uuccugagcaucaugucccccgagauu

SEQ ID NO: 68341 - RNA, 33 nt, Artificial Sequence
  Vitamin K-dependent protein S (26-36)
uuccugagcaagcagcaagccucccaggugcuc

SEQ ID NO: 68342 - RNA, 36 nt, Artificial Sequence
  Vitamin K-dependent protein S (26-37)
uuccugagcaagcagcaagccucccaggugcucguc

SEQ ID NO: 68343 - RNA, 24 nt, Artificial Sequence
  mRNA-decapping enzyme 1A (523-530)
uuccugagcacccuccacgaggug

SEQ ID NO: 68344 - RNA, 27 nt, Artificial Sequence
  Lysosomal-trafficking regulator (12-20)
uuccugaccgacgugaacagacucugc

SEQ ID NO: 68345 - RNA, 30 nt, Artificial Sequence; identical to SEQ ID NO: 44118
  L-dopachrome tautomerase (52-61)

SEQ ID NO: 68346 - RNA, 33 nt, Artificial Sequence
  L-dopachrome tautomerase (52-62)
uuccugaccagcgaccagcucggcuacuccuau

SEQ ID NO: 68347 - RNA, 27 nt, Artificial Sequence
  Bifunctional glutamate/proline-tRNA ligase (1167-1175)
uuccuguggcaggagggccacagcgcc

SEQ ID NO: 68348 - RNA, 27 nt, Artificial Sequence
  Fatty acyl-CoA reductase 1 (362-370)
uuccuguacgacaucuaucucagaaug

SEQ ID NO: 68349 - RNA, 27 nt, Artificial Sequence
  Tetratricopeptide repeat protein 17 (740-748)
uuccuguacaacaucaccagcuccgug

SEQ ID NO: 68350 - RNA, 27 nt, Artificial Sequence
  Chromodomain-helicase-DNA-binding protein 1-like (358-366)
uuccuguacagcggcgggcacagagug

SEQ ID NO: 68351 - RNA, 27 nt, Artificial Sequence
  Ropporin-1A (163-171)
uuccuguacaccuauaucgccaaggug

SEQ ID NO: 68352 - RNA, 27 nt, Artificial Sequence
  Histone deacetylase 11 (141-149)
uucauggacgauaagagaguguacauc

SEQ ID NO: 68353 - RNA, 27 nt, Artificial Sequence
  Pre-mRNA-processing-splicing factor 8 (1561-1569)
uucaugcacggcaagauccccacccug

SEQ ID NO: 68354 - RNA, 27 nt, Artificial Sequence
  Maltase-glucoamylase (551-559)
uucaugaacaauagaagcuuuauccug

SEQ ID NO: 68355 - RNA, 27 nt, Artificial Sequence
  Adenosine 3'-phospho 5'-phosphosulfate transporter 1 (49-57)
uucauggugcccggcuaccugcucguc

SEQ ID NO: 68356 - RNA, 27 nt, Artificial Sequence
  DNA-directed RNA polymerase II subunit RPB1 (1247-1255)
uucaacgacgauaaugccgagaagcug

SEQ ID NO: 68357 - RNA, 27 nt, Artificial Sequence
  Tumor susceptibility gene 101 protein (44-52)
uucaacgacggcagcuccagagagcug

SEQ ID NO: 68358 - RNA, 27 nt, Artificial Sequence
  Amyloid-like protein 2 (10-18)
uucaacggcaaugggaagaucaacgug

SEQ ID NO: 68359 - RNA, 21 nt, Artificial Sequence
  Cytoplasmic FMR1-interacting protein 1 (472-478)
uucaaccacgccaucagacau

SEQ ID NO: 68360 - RNA, 30 nt, Artificial Sequence
  WD repeat-containing protein 19 (187-196)
uuccccgacccuaacggcaccagacuggug

SEQ ID NO: 68361 - RNA, 24 nt, Artificial Sequence
  WD repeat-containing protein 6 (464-471)
uuccccggcaaggugcacagccug

SEQ ID NO: 68362 - RNA, 30 nt, Artificial Sequence
  Collagen alpha-1(VIII) chain (279-288)
uuccccggcccucaggggccacugggaaag

SEQ ID NO: 68363 - RNA, 24 nt, Artificial Sequence
  Proline and serine-rich protein 1 (159-166)
uuccccggcaccccucugaagaaa

SEQ ID NO: 68364 - RNA, 24 nt, Artificial Sequence
  Patatin-like phospholipase domain-containing protein 2 (454-461)
uuccccccugaggcccugagaaug

SEQ ID NO: 68365 - RNA, 27 nt, Artificial Sequence
  Non-POU domain-containing octamer-binding protein (129-137)
uuccccagaccugugaccgucgagcca

SEQ ID NO: 68366 - RNA, 27 nt, Artificial Sequence
  Alpha-mannosidase 2x (42-50)
uuccccagaagccagaucuccgugcug

SEQ ID NO: 68367 - RNA, 30 nt, Artificial Sequence
  Transformation/transcription domain-associated protein (2223-2232)
uuccccaccgagccuagcacauccucugug

SEQ ID NO: 68368 - RNA, 27 nt, Artificial Sequence
  Protein 4.1 (223-231)
uuccccuggccuaaggugcugaaaauc

SEQ ID NO: 68369 - RNA, 24 nt, Artificial Sequence
  DNA polymerase alpha catalytic subunit (594-601)
uuccccuacgccuuuaaggaggug

SEQ ID NO: 68370 - RNA, 27 nt, Artificial Sequence
  DnaJ homolog subfamily C member 11 (314-322)
uuccaggacgaugaccaaaccagagug

SEQ ID NO: 68371 - RNA, 24 nt, Artificial Sequence
  Structural maintenance of chromosomes flexible hinge domain-containing protein 1 (1128-1135)
uuccaggacgaucacgugagccug

SEQ ID NO: 68372 - RNA, 27 nt, Artificial Sequence
  Serine/threonine-protein kinase MRCK alpha (144-152)
uuccaggacgauaacaaucuguaccuc

SEQ ID NO: 68373 - RNA, 27 nt, Artificial Sequence
  Zinc finger HIT domain-containing protein 1 (40-48)
uuccaggacgauccccacgccggccug

SEQ ID NO: 68374 - RNA, 27 nt, Artificial Sequence
  General transcription factor 3C polypeptide 1 (734-742)
uuccaggacaaggaucaaguguuuauc

SEQ ID NO: 68375 - RNA, 27 nt, Artificial Sequence
  Citron Rho-interacting kinase (164-172)
uuccaggacaagaaccaccuguaccuc

SEQ ID NO: 68376 - RNA, 27 nt, Artificial Sequence
  Protein PRR14L (1088-1096)
uuccaggaggacagcagauccacccug

SEQ ID NO: 68377 - RNA, 24 nt, Artificial Sequence
  Plectin (2903-2910)
uuccagggcaagaccgugacaauc

SEQ ID NO: 68378 - RNA, 21 nt, Artificial Sequence
  Proteasome activator complex subunit 4 (789-795)
uuccagggcagccacaagcau

SEQ ID NO: 68379 - RNA, 27 nt, Artificial Sequence
  Heat shock 70 kDa protein 1B (21-29)
uuccagcacggcaagguggagaucauu

SEQ ID NO: 68380 - RNA, 27 nt, Artificial Sequence
  Spatacsin (332-340)
uuccagaucgacagaagcuggaaggcc

SEQ ID NO: 68381 - RNA, 24 nt, Artificial Sequence
  Sodium/potassium-transporting ATPase subunit alpha-3 (948-955)
uuccagcaaggcaugaagaacaaa

SEQ ID NO: 68382 - RNA, 33 nt, Artificial Sequence
  Gamma-secretase C-terminal fragment 59 (565-575)
uucagacacgacagcggcuacgaggugcaucac

SEQ ID NO: 68383 - RNA, 36 nt, Artificial Sequence
  Gamma-secretase C-terminal fragment 59 (565-576)
uucagacacgacagcggcuacgaggugcaucaccag

SEQ ID NO: 68384 - RNA, 24 nt, Artificial Sequence
  60S ribosomal protein L4 (257-264)
uucagaaagcuggacgagcucuac

SEQ ID NO: 68385 - RNA, 27 nt, Artificial Sequence
  Annexin A5 (288-296)
uucagaaagaacuuugccaccagccug

SEQ ID NO: 68386 - RNA, 27 nt, Artificial Sequence
  Glycogen phosphorylase, brain form (546-554)
uucagcgccuuucuggagaaggaauac

SEQ ID NO: 68387 - RNA, 21 nt, Artificial Sequence
  Erlin-2 (43-49)
uucagcgccgugcacaagauc

SEQ ID NO: 68388 - RNA, 27 nt, Artificial Sequence
  Myb-binding protein 1A (239-247)
uucagcgacgagaacgugcccagacug

SEQ ID NO: 68389 - RNA, 24 nt, Artificial Sequence
  Leucine zipper putative tumor suppressor 1 (232-239)
uucagcgacggcggguccaagcug

SEQ ID NO: 68390 - RNA, 27 nt, Artificial Sequence
  Basic leucine zipper and W2 domain-containing protein 2 (143-151)
uucagcgagaccgaacagacaaagcug

SEQ ID NO: 68391 - RNA, 30 nt, Artificial Sequence
  Cytoplasmic dynein 2 heavy chain 1 (202-211)
uucagcgagaccggcgggggagaaaaguac

SEQ ID NO: 68392 - RNA, 27 nt, Artificial Sequence
  Dual specificity protein phosphatase 4 (366-374)
uucagcuuucccguguccgucggcguu

SEQ ID NO: 68393 - RNA, 30 nt, Artificial Sequence; identical to SEQ ID NO: 44166
  Protein FAM135A (667-676)

SEQ ID NO: 68394 - RNA, 27 nt, Artificial Sequence
  Uncharacterized protein C20orf194 (1005-1013)
uucagcggcaacaucuaccacauucug

SEQ ID NO: 68395 - RNA, 24 nt, Artificial Sequence
  RNA-binding protein FUS (355-362)
uucagcggcaaccccaucaaggug

SEQ ID NO: 68396 - RNA, 24 nt, Artificial Sequence
  5,6-dihydroxyindole-2-carboxylic acid oxidase (213-220)
uucagccacgagggccccgccuuu

SEQ ID NO: 68397 - RNA, 24 nt, Artificial Sequence
  L-dopachrome tautomerase (209-216)
uucagccaccagggccccgccuuu

SEQ ID NO: 68398 - RNA, 33 nt, Artificial Sequence
  Homeobox protein Hox-B7 (11-21)
uucagcaaguaccccgccuccucuucaguguuu

SEQ ID NO: 68399 - RNA, 33 nt, Artificial Sequence
  Sodium/potassium/calcium exchanger 1 (352-362)
uucagccugaucaacggccuccagcccgugccu

SEQ ID NO: 68400 - RNA, 27 nt, Artificial Sequence
  Small subunit processome component 20 homolog (925-933)
uucagcaaccccagagcccuguaccuc

SEQ ID NO: 68401 - RNA, 42 nt, Artificial Sequence
  Paired box protein Pax-1 (59-72)
uucagccccuccggcucucugcucucaggggccagugcugag

SEQ ID NO: 68402 - RNA, 21 nt, Artificial Sequence
  ADP-ribosylation factor 4 (9-15)
uucagcagacuguuuggcaag

SEQ ID NO: 68403 - RNA, 30 nt, Artificial Sequence
  Synemin (764-773)
uucagcgugcccuuuaaggucgaggaaguu

SEQ ID NO: 68404 - RNA, 30 nt, Artificial Sequence
  Elongation factor 1-gamma (335-344)
uucagcugggagggcgccuuucagcacgug

SEQ ID NO: 68405 - RNA, 27 nt, Artificial Sequence
  Eukaryotic translation initiation factor 3 subunit H (135-143)
uucagcuaccagcacgccaucgaggaa

SEQ ID NO: 68406 - RNA, 24 nt, Artificial Sequence
  Bcl-2-associated transcription factor 1 (338-345)
uucaccgacgaggaaagcagagug

SEQ ID NO: 68407 - RNA, 27 nt, Artificial Sequence
  Nuclear pore complex protein Nup160 (151-159)
uucaccgacaucggcaagguggauuuu

SEQ ID NO: 68408 - RNA, 24 nt, Artificial Sequence
  Homeobox protein TGIF1 (222-229)
uucaccgacacaagccugauguac

SEQ ID NO: 68409 - RNA, 27 nt, Artificial Sequence
  Transmembrane 9 superfamily member 4 (168-176)
uucaccgacgugaacaagaucuaccug

SEQ ID NO: 68410 - RNA, 27 nt, Artificial Sequence
  Fibronectin isoform 7 (286-294)
uucaccgacgugagagccgcugucuac

SEQ ID NO: 68411 - RNA, 27 nt, Artificial Sequence
  Integrator complex subunit 1 (745-753)
uucaccgagcagcccgaaacauacuau

SEQ ID NO: 68412 - RNA, 27 nt, Artificial Sequence
  CUB and sushi domain-containing protein 1 (3053-3061)
uucaccuuuaacaagacagugagcuac

SEQ ID NO: 68413 - RNA, 21 nt, Artificial Sequence
  Up-regulated during skeletal muscle growth protein 5 (12-18)
uucaccggcaucaagaaauac

SEQ ID NO: 68414 - RNA, 21 nt, Artificial Sequence
  Bestrophin-1 (575-581)
uucaccggcauccuggggaag

SEQ ID NO: 68415 - RNA, 27 nt, Artificial Sequence
  Ribosomal protein S6 kinase alpha-3 (519-527)
uucaccaucacaaagacuguggaguac

SEQ ID NO: 68416 - RNA, 27 nt, Artificial Sequence
  Nuclear factor erythroid 2-related factor 1 (300-308)
uucaccaacgacaagaucauuaaucug

SEQ ID NO: 68417 - RNA, 27 nt, Artificial Sequence
  Serine-threonine kinase receptor-associated protein (108-116)
uucacccaggacagcaacuaccugcuc

SEQ ID NO: 68418 - RNA, 39 nt, Artificial Sequence
  FXYD domain-containing ion transport regulator 3 isoform 3 (28-40)
uucacccagagcccccugcacggcgccgcugcagccuac

SEQ ID NO: 68419 - RNA, 30 nt, Artificial Sequence
  FRAS1-related extracellular matrix protein 1 (471-480)
uucaccguggccgaccugcaggcuggcguc

SEQ ID NO: 68420 - RNA, 27 nt, Artificial Sequence
  CUB and sushi domain-containing protein 1 (2875-2883)
uucaccuacggcgccgugguccacuau

SEQ ID NO: 68421 - RNA, 27 nt, Artificial Sequence
  Fibronectin (364-372)
uucaccuacaacggcagaacauuuuau

SEQ ID NO: 68422 - RNA, 27 nt, Artificial Sequence
  Leucine-rich repeat protein 1 (73-81)
uucguggacgagggcaaggccaccguc

SEQ ID NO: 68423 - RNA, 21 nt, Artificial Sequence
  Protein FAM127B (50-56)
uucguggacgagaacaccuuu

SEQ ID NO: 68424 - RNA, 27 nt, Artificial Sequence
  Calsyntenin-1 (820-828)
uucguggaccugagcggccacaaccuc

SEQ ID NO: 68425 - RNA, 27 nt, Artificial Sequence
  Ras-specific guanine nucleotide-releasing factor RalGPS2 (272-280)
uucguggaggacgauaacuacaagcug

SEQ ID NO: 68426 - RNA, 27 nt, Artificial Sequence
  Smith-Magenis syndrome chromosomal region candidate gene 8 protein (117-125)
uucguggaggacagcaaggucguucug

SEQ ID NO: 68427 - RNA, 27 nt, Artificial Sequence
  (38-46)
uucguggaggaaaccgucuaccugcuc

SEQ ID NO: 68428 - RNA, 39 nt, Artificial Sequence
  Tubulin beta chain (110-122)
uucguguuuggccagagcggggccggaaacaauugggcu

SEQ ID NO: 68429 - RNA, 27 nt, Artificial Sequence
  2-hydroxyacylsphingosine 1-beta-galactosyltransferase (145-153)
uucgugaucgcccaccugcucggcguc

SEQ ID NO: 68430 - RNA, 27 nt, Artificial Sequence
  Glioma tumor suppressor candidate region gene 1 protein (784-792)
uucgugauccagaaccaacugggcguc

SEQ ID NO: 68431 - RNA, 27 nt, Artificial Sequence
  40S ribosomal protein S26 (39-47)
uucgugaucagaaacauugucgaggcc

SEQ ID NO: 68432 - RNA, 27 nt, Artificial Sequence
  Kelch-like protein 7 (430-438)
uucgugaaggacaaaaucuuugccguc

SEQ ID NO: 68433 - RNA, 27 nt, Artificial Sequence
  Tectonic-1 (346-354)
uucgugcugggcaccgucagcuccguu

SEQ ID NO: 68434 - RNA, 27 nt, Artificial Sequence
  Zinc finger protein 618 (573-581)
uucgugaugagcgagaucagaaccguc

SEQ ID NO: 68435 - RNA, 30 nt, Artificial Sequence; identical to SEQ ID NO: 44208
  Integrin alpha-11 (525-534)

SEQ ID NO: 68436 - RNA, 33 nt, Artificial Sequence; identical to SEQ ID NO: 44209
  Protein disulfide-isomerase TMX3 (154-164)

SEQ ID NO: 68437 - RNA, 27 nt, Artificial Sequence
  Palmitoyl-protein thioesterase 1 (194-202)
uucuacgcccacaucauucccuuucug

SEQ ID NO: 68438 - RNA, 27 nt, Artificial Sequence
  Serine/threonine-protein kinase 36 (200-208)
uucuacgccaccagcaucuuucagcug

SEQ ID NO: 68439 - RNA, 27 nt, Artificial Sequence
  Tetratricopeptide repeat protein 31 (320-328)
uucuaccacgaggccgugguccuguuu

SEQ ID NO: 68440 - RNA, 30 nt, Artificial Sequence
  Ubinuclein-1 (160-169)
uucuacaucaacagcggcacccugcaguuu

SEQ ID NO: 68441 - RNA, 21 nt, Artificial Sequence
  HLA class I histocompatibility antigen, B-15 alpha chain (232-238)
uucuaccccgccgagaucacc

SEQ ID NO: 68442 - RNA, 27 nt, Artificial Sequence
  PX domain-containing protein kinase-like protein (233-241)
uucuacagaagcuauuuuucccaguuc

SEQ ID NO: 68443 - RNA, 27 nt, Artificial Sequence
  HLA class II histocompatibility antigen, DO alpha chain (163-171)
uucuacagccagcccgaccaccuguuu

SEQ ID NO: 68444 - RNA, 33 nt, Artificial Sequence
  Hypoxia-inducible factor 1-alpha (545-555)
uucuacguggacagcgauauggucaacgaguuu

SEQ ID NO: 68445 - RNA, 66 nt, Artificial Sequence
  Neurobeachin (23-44)
ggcgccgcugggggagguggcgggggaagcggcggugggggaaccggcggcuccgggaugggagag

SEQ ID NO: 68446 - RNA, 27 nt, Artificial Sequence
  Myb-binding protein 1A (310-318)
ggcgccgcucugccccuccuuaccaag

SEQ ID NO: 68447 - RNA, 27 nt, Artificial Sequence
  Neutral amino acid transporter A (59-67)
ggcgccgcucugagagggcucagccuu

SEQ ID NO: 68448 - RNA, 48 nt, Artificial Sequence
  Beta-secretase 2 (73-88)
ggcgccgcuaacuuccuggcaaugguggacaaucuccagggggauagc

SEQ ID NO: 68449 - RNA, 39 nt, Artificial Sequence
  Transcription factor E2F3 (21-33)
ggcgccgcuguggucgcagccgcggcugccgcaagcaug

SEQ ID NO: 68450 - RNA, 27 nt, Artificial Sequence
  U3 small nucleolar RNA-associated protein 15 homolog (121-129)
ggcgccgacgauuacaccgugaagcug

SEQ ID NO: 68451 - RNA, 27 nt, Artificial Sequence
  Pre-mRNA-processing factor 19 (241-249)
ggcgccgacaagaacguggucguuuuc

SEQ ID NO: 68452 - RNA, 57 nt, Artificial Sequence
  Myc-associated zinc finger protein (303-321)
ggcgccgggggagguggcggggaggcuggagcaggcgguggggccgcggcuguggcc

SEQ ID NO: 68453 - RNA, 36 nt, Artificial Sequence
  High affinity cationic amino acid transporter 1 (35-46)
ggcgccgggguguacguccuggcuggagcaguugcc

SEQ ID NO: 68454 - RNA, 39 nt, Artificial Sequence
  Cytochrome c oxidase subunit 5B, mitochondrial (117-129)
ggcgcccacuacaagcuggugccccagcaacucgcucau

SEQ ID NO: 68455 - RNA, 45 nt, Artificial Sequence
  Adenosylhomocysteinase 3 (39-53)
ggcgccauggcucccccugcagggggaggugacccagaggccccg

SEQ ID NO: 68456 - RNA, 39 nt, Artificial Sequence
  Sickle tail protein homolog (296-308)
ggcgcccccagaccugggagcaccgcucacccaccgcau

SEQ ID NO: 68457 - RNA, 33 nt, Artificial Sequence
  Fibrocystin (1261-1271)
ggcgcccccaccgugccugcugcagucgagguu

SEQ ID NO: 68458 - RNA, 57 nt, Artificial Sequence
  Collagen alpha-1(XVIII) chain (992-1010)
ggcgccagaggggagagcggacuggcuggugcacccggcccugccgggccaccggga

SEQ ID NO: 68459 - RNA, 24 nt, Artificial Sequence
  Mastermind-like protein 2 (85-92)
ggcgccagaaaggcugggaaacac

SEQ ID NO: 68460 - RNA, 99 nt, Artificial Sequence
  Frizzled-8 (634-666)
ggcgccaccgcugcagggggagguggcgggcccggaggcggugggggaggcggcccugggggagguggcgggccaggaggcggugggggaagccuguac

SEQ ID NO: 68461 - RNA, 60 nt, Artificial Sequence
  26S protease regulatory subunit 6A (376-395)
ggcgccaccgagcugacacacgaagacuacauggaggggauccucgaagugcaggcuaag

SEQ ID NO: 68462 - RNA, 36 nt, Artificial Sequence
  Vesicle transport protein SFT2C (154-165)
ggcgccacccuguucgcugcacucgggcuuagaagc

SEQ ID NO: 68463 - RNA, 45 nt, Artificial Sequence
  Chondroitin sulfate proteoglycan 4 (2058-2072)
ggcgccacccugagacucgaccccacagugcuugaugcuggggag

SEQ ID NO: 68464 - RNA, 27 nt, Artificial Sequence
  Pecanex-like protein 3 (1088-1096)
ggcgccgugggguucuuuacccacuac

SEQ ID NO: 68465 - RNA, 27 nt, Artificial Sequence
  Pecanex-like protein 2 (267-275)
ggcgccgugggguucgucacccacuac

SEQ ID NO: 68466 - RNA, 27 nt, Artificial Sequence
  Tensin-3 (1204-1212)
ggcgccuacgggcuggcuaugaaggug

SEQ ID NO: 68467 - RNA, 69 nt, Artificial Sequence
  Cytochrome c oxidase subunit 6A1, mitochondrial (64-86)
ggcgacgggaaccacacccuguuccauaauccccacgugaacccucucccaacaggauacgaggaugaa

SEQ ID NO: 68468 - RNA, 54 nt, Artificial Sequence
  Cadherin-2 (266-283)
ggcgaccccaccgggagauucgccauccagacagauccuaacagcaaugacgga

SEQ ID NO: 68469 - RNA, 30 nt, Artificial Sequence
  E3 ubiquitin-protein ligase makorin-1 (147-156)
ggcgaggccgaaagcagaaacuccaauuuc

SEQ ID NO: 68470 - RNA, 30 nt, Artificial Sequence
  Suppression of tumorigenicity 5 protein (770-779)
ggcgaggacgggagcagaagguucggauac

SEQ ID NO: 68471 - RNA, 33 nt, Artificial Sequence
  Melanotransferrin (422-432)
ggcgaggacaucuacaccgccgggaagacauau

SEQ ID NO: 68472 - RNA, 30 nt, Artificial Sequence
  Protein capicua homolog (1390-1399)
ggcgaggaccccgaagggaacaagggauuc

SEQ ID NO: 68473 - RNA, 63 nt, Artificial Sequence
  Eukaryotic translation initiation factor 5A-1 (130-150)
ggcgaggaaauccugauuaccgugcucagcgccaugacagaggaagcugcagucgccauaaag

SEQ ID NO: 68474 - RNA, 27 nt, Artificial Sequence
  Nucleosome-remodeling factor subunit BPTF (1023-1031)
ggcgaggaauacagagugaccggguau

SEQ ID NO: 68475 - RNA, 48 nt, Artificial Sequence
  Gamma-interferon-inducible protein 16 (644-659)
ggcgaguucaccuacuaugaaauccaggacaacacagggaagauggag

SEQ ID NO: 68476 - RNA, 27 nt, Artificial Sequence
  Cyclin-dependent kinase 6 (20-28)
ggcgagggggccuacggaaagguguuc

SEQ ID NO: 68477 - RNA, 24 nt, Artificial Sequence
  Nestin (495-502)
ggcgagggggaaggacagaucugg

SEQ ID NO: 68478 - RNA, 27 nt, Artificial Sequence
  Zinc finger and BTB domain-containing protein 10 (226-234)
ggcgagggggaaaccgugcagcacuuc

SEQ ID NO: 68479 - RNA, 30 nt, Artificial Sequence
  Matrix metalloproteinase-24 (185-194)
ggcgaggggggauuccuggcccacgcuuac

SEQ ID NO: 68480 - RNA, 27 nt, Artificial Sequence
  Filamin-B (1548-1556)
ggcgaggggcugcucgccgugcagauc

SEQ ID NO: 68481 - RNA, 30 nt, Artificial Sequence
  Chondroitin sulfate proteoglycan 4 (1563-1572)
ggcgagcacaccagccccgggcauuucuuu

SEQ ID NO: 68482 - RNA, 27 nt, Artificial Sequence
  EKC/KEOPS complex subunit TPRKB (113-121)
ggcgagaagcagaucaaccaagaauac

SEQ ID NO: 68483 - RNA, 27 nt, Artificial Sequence
  Peroxisomal biogenesis factor 19 (180-188)
ggcgagaugcccccugggcugaacuuc

SEQ ID NO: 68484 - RNA, 27 nt, Artificial Sequence
  TRAF2 and NCK-interacting protein kinase (434-442)
ggcgagaugcccaccagcguggccuac

SEQ ID NO: 68485 - RNA, 30 nt, Artificial Sequence
  Girdin (1244-1253)
ggcgagaacgacagacugaaucacaccuac

SEQ ID NO: 68486 - RNA, 30 nt, Artificial Sequence
  Plectin (1154-1163)
ggcgagagagacguggaagucgagaggugg

SEQ ID NO: 68487 - RNA, 27 nt, Artificial Sequence
  Fragile X mental retardation syndrome-related protein 1 (266-274)
ggcgagagcgccgacgcugugaagaaa

SEQ ID NO: 68488 - RNA, 27 nt, Artificial Sequence
  Nestin (482-490)
ggcgagagcgggggauccagaguguuc

SEQ ID NO: 68489 - RNA, 27 nt, Artificial Sequence
  Protein MON2 homolog (918-926)
ggcgagagccugaucagaaccgccuuc

SEQ ID NO: 68490 - RNA, 30 nt, Artificial Sequence
  Synemin (317-326)
ggcgagagcaaccccgaaaucgugauuugg

SEQ ID NO: 68491 - RNA, 27 nt, Artificial Sequence
  Protein piccolo (255-263)
ggcgagagcgugaagcccucccugccu

SEQ ID NO: 68492 - RNA, 30 nt, Artificial Sequence
  Vacuolar protein sorting-associated protein 18 homolog (657-666)
ggcgagaccgaacaggccauccacaacuac

SEQ ID NO: 68493 - RNA, 30 nt, Artificial Sequence
  Spectrin beta chain, non-erythrocytic 2 (1112-1121)
ggcgagguggaaagagcccagagcgaguac

SEQ ID NO: 68494 - RNA, 27 nt, Artificial Sequence
  ATP-citrate synthase (392-400)
ggcgagguggggaagaccacaggaauc

SEQ ID NO: 68495 - RNA, 27 nt, Artificial Sequence
  Hermansky-Pudlak syndrome 5 protein (252-260)
ggcgaggugaucagcacccaccaguuc

SEQ ID NO: 68496 - RNA, 36 nt, Artificial Sequence
  Serum albumin (423-434)
ggcgaguacaaguuccagaacgcccugcucgugaga

SEQ ID NO: 68497 - RNA, 33 nt, Artificial Sequence
  HLA class I histocompatibility antigen, B-15 alpha chain (231-241)
ggcuucuaccccgccgagaucacccugacaugg

SEQ ID NO: 68498 - RNA, 60 nt, Artificial Sequence
  Transcription factor Maf (211-230)
ggcggggccggaggugcuggcgggggaggccccgcaagcgccggugggggaggcggcggg

SEQ ID NO: 68499 - RNA, 21 nt, Artificial Sequence
  Inhibitor of nuclear factor kappa-B kinase subunit beta (42-48)
ggcggggaccugagaaaguac

SEQ ID NO: 68500 - RNA, 57 nt, Artificial Sequence
  Cadherin-2 (265-283)
ggcggggaccccaccggaagauucgccauccagacagauccuaacagcaaugacggu

SEQ ID NO: 68501 - RNA, 93 nt, Artificial Sequence
  Keratin, type I cytoskeletal 9 (593-623)
ggcggggagagcggagguuccuacggcgggggagaagaggccucuggcucaggugggggauauggcggcgggaguggaaagagcucccacucu

SEQ ID NO: 68502 - RNA, 69 nt, Artificial Sequence
  Prostaglandin reductase 1 (141-163)
ggcggggagaccgugauggucaacgccgcugcaggagccguugguagcgugguaggccagaucgcgaag

SEQ ID NO: 68503 - RNA, 51 nt, Artificial Sequence
  Hemicentin-1 (3579-3595)
ggcgggggagaggugcugagaaucagcaccgcccaggucgaagacacaggu

SEQ ID NO: 68504 - RNA, 57 nt, Artificial Sequence
  Regulator of nonsense transcripts 1 (55-73)
ggcgggggaggugccggcgggcccggaggcgcuggugcaggggccgcggcuggacag

SEQ ID NO: 68505 - RNA, 69 nt, Artificial Sequence
  Electrogenic sodium bicarbonate cotransporter 4 (440-462)
ggcgggggagguggcgcccccgggggaggcaacggugggggaggcggcgggggaagcgguggcggggcu

SEQ ID NO: 68506 - RNA, 51 nt, Artificial Sequence
  AT-rich interactive domain-containing protein 1B (322-338)
ggcgggggagguggcgggggagccggcgcugguggggcaggagccggcgcg

SEQ ID NO: 68507 - RNA, 45 nt, Artificial Sequence
  Neuronal PAS domain-containing protein 3 (734-748)
ggcgggggagguggcgggggagccggcggugggggacccagcgcu

SEQ ID NO: 68508 - RNA, 57 nt, Artificial Sequence
  Homeobox even-skipped homolog protein 2 (416-434)
ggcgggggagguggcgggggaggcggugggggaggcggcgccggggcuggagguggc

SEQ ID NO: 68509 - RNA, 66 nt, Artificial Sequence
  WD repeat-containing protein 26 (8-29)
ggcgggggagguggcgggggaggcggugggggaggcggcgggggagguggcgggcagggacaaacc

SEQ ID NO: 68510 - RNA, 54 nt, Artificial Sequence
  Keratin, type I cytoskeletal 9 (15-32)
ggcgggggagguggcgggggacugggcagcgguggguccaucagaucuucauac

SEQ ID NO: 68511 - RNA, 45 nt, Artificial Sequence
  Zinc finger SWIM domain-containing protein 6 (150-164)
ggcgggggagguggcagcuccucuucacccgccgcuaccagugca

SEQ ID NO: 68512 - RNA, 39 nt, Artificial Sequence
  40S ribosomal protein S16 (74-86)
ggcgggggacacguggcccagaucuacggugagagccaa

SEQ ID NO: 68513 - RNA, 30 nt, Artificial Sequence
  Serine/threonine-protein kinase TAO2 (869-878)
ggcgggggacugcaggccgcucuccuugca

SEQ ID NO: 68514 - RNA, 54 nt, Artificial Sequence
  Keratin, type II cytoskeletal 1 (595-612)
ggcgggggaagcuccgguggcagagggucuggaggcgguucaagugggggaagc

SEQ ID NO: 68515 - RNA, 39 nt, Artificial Sequence
  Keratin, type II cytoskeletal 3 (144-156)
ggcgggggauacgguggcgggaugggaggcggucugggg

SEQ ID NO: 68516 - RNA, 60 nt, Artificial Sequence
  Protein scribble homolog (1289-1308)
ggcgggaagauggccgagagccccugcuccccuucuggacagcaaccaccgucacccccu

SEQ ID NO: 68517 - RNA, 39 nt, Artificial Sequence
  Protein TASOR (44-56)
ggcgggcugaacaucgccgagcccagcggaggugcuggc

SEQ ID NO: 68518 - RNA, 78 nt, Artificial Sequence
  Keratin, type I cytoskeletal 18 (56-81)
ggcgggaugggaagcgguggccuggccaccgggaucgcuggaggccucgcagguauggggggaauucagaacgagaag

SEQ ID NO: 68519 - RNA, 54 nt, Artificial Sequence
  Inositol 1,4,5-trisphosphate receptor type 1 (1761-1778)
ggcgggcccggaaagccugguggcgggggaggcgguagcggguccucuucaaug

SEQ ID NO: 68520 - RNA, 30 nt, Artificial Sequence
  KN motif and ankyrin repeat domain-containing protein 2 (473-482)
ggcgggcccccugccggagugagaagcauc

SEQ ID NO: 68521 - RNA, 39 nt, Artificial Sequence
  AT-rich interactive domain-containing protein 1A (277-289)
ggcgggcccagcgccgcuggagguggcaccccucagcca

SEQ ID NO: 68522 - RNA, 48 nt, Artificial Sequence
  Protein transport protein Sec24C (725-740)
ggcgggagcguguacaaguaugccuccuuccaggucgagaacgaccaa

SEQ ID NO: 68523 - RNA, 75 nt, Artificial Sequence
  HLA class I histocompatibility antigen, A-1 alpha chain (316-340)
ggcgggagcuacacccaggccgcuuccucugacucagcacaaggaagugaugugagccugacagccugcaagguc

SEQ ID NO: 68524 - RNA, 27 nt, Artificial Sequence
  Abl interactor 2 (222-230)
ggccaccccgugcaguucuacagcaug

SEQ ID NO: 68525 - RNA, 84 nt, Artificial Sequence
  Guanine nucleotide-binding protein subunit beta-2-like 1 (61-88)
ggccacagccauuucguguccgacgucguuaucucuucagaugggcaguuugcccugaguggaagcugggacgguacccucaga

SEQ ID NO: 68526 - RNA, 27 nt, Artificial Sequence
  Spatacsin (1079-1087)
ggccacacccugcucgcccuugcuaca

SEQ ID NO: 68527 - RNA, 27 nt, Artificial Sequence
  Protein Jumonji (51-59)
ggcaucgccgggagccugaagaccgug

SEQ ID NO: 68528 - RNA, 27 nt, Artificial Sequence
  Lipoprotein lipase (23-31)
ggcaucgccgggagccugaccaacaag

SEQ ID NO: 68529 - RNA, 39 nt, Artificial Sequence
  Protein transport protein Sec16A (84-96)
ggcaucgccaacccccugcucgcugugccugcaccaagc

SEQ ID NO: 68530 - RNA, 30 nt, Artificial Sequence
  Interferon alpha-inducible protein 27, mitochondrial (57-66)
ggcaucgccagcuccucuauugcugcaaag

SEQ ID NO: 68531 - RNA, 27 nt, Artificial Sequence
  HLA class II histocompatibility antigen, DQ beta 1 chain (233-241)
ggcaucgggggauucgugcugggucuc

SEQ ID NO: 68532 - RNA, 27 nt, Artificial Sequence
  Probable methyltransferase TARBP1 (1190-1198)
ggcaucauugacagaauauuccaggcc

SEQ ID NO: 68533 - RNA, 114 nt, Artificial Sequence
  Glyceraldehyde-3-phosphate dehydrogenase (272-309)
ggcauccugggguacaccgagcaccagguggucagcuccgacuucaacucugauacacauucaaguacuuuugacgccggagcugguauugcacucaaugaucacuucguuaag

SEQ ID NO: 68534 - RNA, 27 nt, Artificial Sequence
  Zinc finger ZZ-type and EF-hand domain-containing protein 1 (2890-2898)
ggcauccugcucccccuucacagagcc

SEQ ID NO: 68535 - RNA, 24 nt, Artificial Sequence
  HEAT repeat-containing protein 5A (975-982)
ggcaucagaaacgggagcugcucc

SEQ ID NO: 68536 - RNA, 27 nt, Artificial Sequence
  NHP2-like protein 1 (49-57)
ggcaucagcgaguucauugugauggcc

SEQ ID NO: 68537 - RNA, 27 nt, Artificial Sequence
  Putative segment polarity protein dishevelled homolog DVL1P1 (277-285)
ggcaucuacauugggagcauaaugaag

SEQ ID NO: 68538 - RNA, 27 nt, Artificial Sequence
  Afadin (1018-1026)
ggcaucuacgugaagagcgucguuaaa

SEQ ID NO: 68539 - RNA, 21 nt, Artificial Sequence
  Mesoderm induction early response protein 3 (303-309)
ggcaaggacuuccaccugauc

SEQ ID NO: 68540 - RNA, 36 nt, Artificial Sequence
  Leucine-rich repeat serine/threonine-protein kinase 2 (780-791)
ggcaagggggacagccagaucauuucccugcuccuu

SEQ ID NO: 68541 - RNA, 33 nt, Artificial Sequence
  E1A-binding protein p400 (281-291)
ggcaagaccaucacacccgcccacuuccagcug

SEQ ID NO: 68542 - RNA, 30 nt, Artificial Sequence
  Probable E3 ubiquitin-protein ligase HERC1 (2585-2594)
ggccuggccgaccucgagagagcucaggca

SEQ ID NO: 68543 - RNA, 27 nt, Artificial Sequence
  Minor histocompatibility antigen H13 (189-197)
ggccuggccuucagccucaacggggug

SEQ ID NO: 68544 - RNA, 27 nt, Artificial Sequence
  Serpin H1 (48-56)
ggccuggccuucagccucuaccaggcu

SEQ ID NO: 68545 - RNA, 27 nt, Artificial Sequence
  Ral GTPase-activating protein subunit beta (790-798)
ggccuggccaaggugaaagucaugguu

SEQ ID NO: 68546 - RNA, 33 nt, Artificial Sequence
  Equilibrative nucleoside transporter 1 (483-493)
ggccuggcccucggggcuguguucagcuuucuu

SEQ ID NO: 68547 - RNA, 33 nt, Artificial Sequence
  Prominin-2 (17-27)
ggccuggcccucagccagcuugcugcaggggcc

SEQ ID NO: 68548 - RNA, 27 nt, Artificial Sequence
  Vacuolar protein sorting-associated protein 41 homolog (323-331)
ggccuggccuacaucaaccaccucgug

SEQ ID NO: 68549 - RNA, 27 nt, Artificial Sequence
  Zinc finger and BTB domain-containing protein 39 (63-71)
ggccuggacgccgcuagaaccuacgug

SEQ ID NO: 68550 - RNA, 27 nt, Artificial Sequence
  C-type lectin domain family 11 member A (117-125)
ggccuggacgccgggcuccaccagcuu

SEQ ID NO: 68551 - RNA, 30 nt, Artificial Sequence
  Protein PRR14L (130-139)
ggccuggacgagcucgauggggugaaggcc

SEQ ID NO: 68552 - RNA, 27 nt, Artificial Sequence
  Protein furry homolog-like (621-629)
ggccuggacaacgagacccacuuccuc

SEQ ID NO: 68553 - RNA, 27 nt, Artificial Sequence
  Heat shock 70 kDa protein 12A (522-530)
ggccuggaccccgccgugaucaagguc

SEQ ID NO: 68554 - RNA, 27 nt, Artificial Sequence
  DNA polymerase alpha catalytic subunit (1240-1248)
ggccuggaccccacccaguucagagug

SEQ ID NO: 68555 - RNA, 27 nt, Artificial Sequence
  Sodium- and chloride-dependent creatine transporter 1 (299-307)
ggccuggacagccaguucguggggguc

SEQ ID NO: 68556 - RNA, 27 nt, Artificial Sequence
  ADP-ribosylation factor 5 (169-177)
ggccuggacuggcucagccacgagcuu

SEQ ID NO: 68557 - RNA, 30 nt, Artificial Sequence
  Trinucleotide repeat-containing gene 18 protein (737-746)
ggccuggaggaaagcgggcucggacuucug

SEQ ID NO: 68558 - RNA, 30 nt, Artificial Sequence
  Rho GTPase-activating protein 23 (525-534)
ggccuggagagcaccgggaucuacagagug

SEQ ID NO: 68559 - RNA, 30 nt, Artificial Sequence
  Ciliary neurotrophic factor (150-159)
ggccuguucgagaagaaacucugggggcuu

SEQ ID NO: 68560 - RNA, 30 nt, Artificial Sequence
  Oxysterol-binding protein-related protein 1 (365-374)
ggccuguucgggaaggagcuccacaaagug

SEQ ID NO: 68561 - RNA, 27 nt, Artificial Sequence
  Receptor-interacting serine/threonine-protein kinase 4 (180-188)
ggccuguucgggaccaucgccuaccuc

SEQ ID NO: 68562 - RNA, 30 nt, Artificial Sequence
  Presenilin-2 (364-373)
ggccugggggacuucaucuuuuacagcgug

SEQ ID NO: 68563 - RNA, 27 nt, Artificial Sequence
  Nurim (175-183)
ggccugggggagccccucgcccuuaag

SEQ ID NO: 68564 - RNA, 24 nt, Artificial Sequence
  Unconventional myosin-Va (1848-1855)
ggccugggguucaucagcagagug

SEQ ID NO: 68565 - RNA, 24 nt, Artificial Sequence
  Probable ATP-dependent RNA helicase YTHDC2 (1364-1371)
ggccuggggggaguguucaagguc

SEQ ID NO: 68566 - RNA, 24 nt, Artificial Sequence
  Sodium-dependent multivitamin transporter (227-234)
ggccuggggagagugugggccguc

SEQ ID NO: 68567 - RNA, 33 nt, Artificial Sequence
  Vacuole membrane protein 1 (126-136)
ggccuggggaccggacuccacacauuccuucug

SEQ ID NO: 68568 - RNA, 36 nt, Artificial Sequence
  Elastin (104-115)
ggccugggggugggagccgguguccccggcuucggg

SEQ ID NO: 68569 - RNA, 27 nt, Artificial Sequence
  Bifunctional heparan sulfate N-deacetylase/N-sulfotransferase 3 (265-273)
ggccugcacgacgggauccagagagug

SEQ ID NO: 68570 - RNA, 27 nt, Artificial Sequence
  Vacuolar protein sorting-associated protein 13D (747-755)
ggccugcacgggcucgugguccaggcc

SEQ ID NO: 68571 - RNA, 27 nt, Artificial Sequence
  Ribosome-binding protein 1 (183-191)
ggccugcacgggcagcuccaagaggcc

SEQ ID NO: 68572 - RNA, 33 nt, Artificial Sequence
  Dystonin (1614-1624)
ggccugaucgacgagcagauucucugccaacuu

SEQ ID NO: 68573 - RNA, 33 nt, Artificial Sequence
  28 kDa heat- and acid-stable phosphoprotein (79-89)
ggccugaucgacauugagaaccccaauagagug

SEQ ID NO: 68574 - RNA, 33 nt, Artificial Sequence
  Dystonin (1576-1586)
ggccugaucgacuacgauaccgggauuagacuc

SEQ ID NO: 68575 - RNA, 42 nt, Artificial Sequence
  ATP-citrate synthase (832-845)
ggccugaucagaaagcccgccagcuucaugaccuccauuugc

SEQ ID NO: 68576 - RNA, 21 nt, Artificial Sequence
  Rho-related BTB domain-containing protein 3 (23-29)
ggccugaucagaaccuaccuc

SEQ ID NO: 68577 - RNA, 27 nt, Artificial Sequence
  Nucleolar protein 6 (323-331)
ggccugaaggacgggguggcccuccuu

SEQ ID NO: 68578 - RNA, 30 nt, Artificial Sequence
  Matrin-3 (27-36)
ggccugcucgccgcugcaacccagagccuu

SEQ ID NO: 68579 - RNA, 27 nt, Artificial Sequence
  Transmembrane protein 223 (112-120)
ggccugcucuucagccuuagauccgug

SEQ ID NO: 68580 - RNA, 27 nt, Artificial Sequence
  Receptor-type tyrosine-protein phosphatase T (1083-1091)
ggccugcucggguucgugagacagguc

SEQ ID NO: 68581 - RNA, 27 nt, Artificial Sequence
  LanC-like protein 1 (313-321)
ggccugcucaagaaaggguacggacuu

SEQ ID NO: 68582 - RNA, 30 nt, Artificial Sequence
  Protein ELYS (20-29)
ggccugcuccccuucccugaggugacccuu

SEQ ID NO: 68583 - RNA, 27 nt, Artificial Sequence
  Protein farnesyltransferase subunit beta (256-264)
ggccugcucccccuucugcacagagcc

SEQ ID NO: 68584 - RNA, 27 nt, Artificial Sequence
  Angiomotin (797-805)
ggccugcucagccacuccucuacccuu

SEQ ID NO: 68585 - RNA, 27 nt, Artificial Sequence
  Helicase SKI2W (380-388)
ggccugcucaccggggacgugcagcuu

SEQ ID NO: 68586 - RNA, 27 nt, Artificial Sequence
  Glycerol-3-phosphate acyltransferase 3 (87-95)
ggccugauggggaucauucagagagcc

SEQ ID NO: 68587 - RNA, 27 nt, Artificial Sequence
  Glycerol-3-phosphate acyltransferase 4 (150-158)
ggccugaugggggugauccagagagcc

SEQ ID NO: 68588 - RNA, 30 nt, Artificial Sequence; identical to SEQ ID NO: 44361
  Contactin-associated protein-like 3B (447-456)

SEQ ID NO: 68589 - RNA, 27 nt, Artificial Sequence
  Basement membrane-specific heparan sulfate proteoglycan core protein (280-288)
ggccugaaccuccacacccuucuguac

SEQ ID NO: 68590 - RNA, 30 nt, Artificial Sequence
  Sorting nexin-18 (488-497)
ggccugaaccaggccaucgcuuucaccggg

SEQ ID NO: 68591 - RNA, 30 nt, Artificial Sequence
  Cell surfaceoprotein MUC18 (416-425)
ggccugaacagaacccagcucgugaauguc

SEQ ID NO: 68592 - RNA, 33 nt, Artificial Sequence
  DnaJ homolog subfamily B member 11 (305-315)
ggccugcccaacuucgacaauaacaauaucaag

SEQ ID NO: 68593 - RNA, 39 nt, Artificial Sequence
  Epidermal growth factor receptor substrate 15 (256-268)
ggccugcccagcacccuccuugcccacaucuggucccug

SEQ ID NO: 68594 - RNA, 27 nt, Artificial Sequence
  Uridine phosphorylase 1 (55-63)
ggccugcaggccgcuguggucugcguu

SEQ ID NO: 68595 - RNA, 36 nt, Artificial Sequence
  Nestin (434-445)
ggccugcaggaccccgaggggcaaagccagcaggug

SEQ ID NO: 68596 - RNA, 45 nt, Artificial Sequence
  Ryanodine receptor 1 (135-149)
ggccugcaggaggacgccaccggggaagcuugcugguggacaaug

SEQ ID NO: 68597 - RNA, 27 nt, Artificial Sequence
  Catenin beta-1 (278-286)
ggccugcagaagaugguggcccuccuu

SEQ ID NO: 68598 - RNA, 27 nt, Artificial Sequence
  Serine hydroxymethyltransferase, mitochondrial (399-407)
ggccugagacucggggcccccgcucuu

SEQ ID NO: 68599 - RNA, 51 nt, Artificial Sequence
  AP-5 complex subunit beta-1 (121-137)
ggccugagacagagggccgcucucgacgggggaccccgggcacuugccacc

SEQ ID NO: 68600 - RNA, 30 nt, Artificial Sequence
  Actin-like protein 6B (313-322)
ggccugagcgggaacaccaugcucggagug

SEQ ID NO: 68601 - RNA, 27 nt, Artificial Sequence
  Melanoma antigen preferentially expressed in tumors (432-440)
ggccugagcaaccucacccacgugcuu

SEQ ID NO: 68602 - RNA, 27 nt, Artificial Sequence
  G-protein coupled receptor 143 (150-158)
ggccugagcaccauccuccuuuaccac

SEQ ID NO: 68603 - RNA, 27 nt, Artificial Sequence
  Purine nucleoside phosphorylase (37-45)
ggccugaccgacaagcucacacaggcc

SEQ ID NO: 68604 - RNA, 30 nt, Artificial Sequence; identical to SEQ ID NO: 44377
  Beta-glucuronidase (23-32)

SEQ ID NO: 68605 - RNA, 114 nt, Artificial Sequence
  Testis anion transporter 1 (103-140)
ggccuggugcaggucccccaagggcucacccuuagccuguuggccagacaguuaaucccuccacugaacauugcuuacgcagccuucugcuccucuguuauauaugugaucuuu

SEQ ID NO: 68606 - RNA, 27 nt, Artificial Sequence
  Laminin subunit alpha-4 (1544-1552)
ggccuguggcacgacgugaucuucauu

SEQ ID NO: 68607 - RNA, 30 nt, Artificial Sequence; identical to SEQ ID NO: 44380
  Disco-interacting protein 2 homolog C (547-556)

SEQ ID NO: 68608 - RNA, 30 nt, Artificial Sequence; identical to SEQ ID NO: 44381
  Disco-interacting protein 2 homolog B (156-165)

SEQ ID NO: 68609 - RNA, 27 nt, Artificial Sequence
  Adhesion G protein-coupled receptor A3 (1170-1178)
ggccuguggaagcacgagaccacagug

SEQ ID NO: 68610 - RNA, 27 nt, Artificial Sequence
  Zinc transporter ZIP14 (20-28)
ggccuguggagaaccacacccgaggcc

SEQ ID NO: 68611 - RNA, 30 nt, Artificial Sequence; identical to SEQ ID NO: 44384
  RNA pseudouridylate synthase domain-containing protein 1 (32-41)

SEQ ID NO: 68612 - RNA, 27 nt, Artificial Sequence
  Lysosomal-trafficking regulator (2306-2314)
ggccuguacgagcuccuuagcggggug

SEQ ID NO: 68613 - RNA, 27 nt, Artificial Sequence
  Zinc finger BED domain-containing protein 1 (137-145)
ggccuguaccccgccagcaucguggac

SEQ ID NO: 68614 - RNA, 27 nt, Artificial Sequence
  ATP-dependent RNA helicase DHX36 (824-832)
ggccuguaccccaagguggccaaaauc

SEQ ID NO: 68615 - RNA, 27 nt, Artificial Sequence
  E3 ubiquitin-protein ligase HERC2 (1628-1636)
ggccuguacccccagagcccucuccuu

SEQ ID NO: 68616 - RNA, 27 nt, Artificial Sequence
  Unconventional myosin-XVIIIa (758-766)
ggccuguacagcgagcucuucacccuu

SEQ ID NO: 68617 - RNA, 27 nt, Artificial Sequence
  Gamma-tubulin complex component 2 (879-887)
ggcauggccagcgugaucuccagacug

SEQ ID NO: 68618 - RNA, 27 nt, Artificial Sequence
  Intraflagellar transport protein 27 homolog (41-49)
ggcauggaccugguggucaagaccguu

SEQ ID NO: 68619 - RNA, 30 nt, Artificial Sequence; identical to SEQ ID NO: 44392
  Lysophosphatidic acid phosphatase type 6 (118-127)

SEQ ID NO: 68620 - RNA, 36 nt, Artificial Sequence
  AP-3 complex subunit beta-1 (317-328)
ggcauguucgagcccuaccugaagagcuuuuaugug

SEQ ID NO: 68621 - RNA, 30 nt, Artificial Sequence
  ATP-dependent RNA helicase DHX29 (113-122)
ggcaugaucagcgggagacugaccgccaag

SEQ ID NO: 68622 - RNA, 27 nt, Artificial Sequence
  Glucocorticoid modulatory element-binding protein 2 (289-297)
ggcaugcuggaccucgugaagaaaguc

SEQ ID NO: 68623 - RNA, 27 nt, Artificial Sequence
  E3 ubiquitin-protein ligase HUWE1 (407-415)
ggcaugauggaggcccugcucaaggug

SEQ ID NO: 68624 - RNA, 27 nt, Artificial Sequence
  Complement receptor type 1 (563-571)
ggcauggugcacgucaucaccgacauu

SEQ ID NO: 68625 - RNA, 33 nt, Artificial Sequence
  Chromodomain-helicase-DNA-binding protein 4 (1035-1045)
ggcauguacgacgggagcgcccugaucagagcu

SEQ ID NO: 68626 - RNA, 30 nt, Artificial Sequence
  Peroxisomal acyl-coenzyme A oxidase 3 (111-120)
ggcauguacgacagcucccuggccgcuaag

SEQ ID NO: 68627 - RNA, 78 nt, Artificial Sequence
  ATP synthase-coupling factor 6, mitochondrial (83-108)
ggcaacgccgacaugaauaccuuccccacauuuaaguucgaggauccuaaauuugaagugaucgagaagccacaggcu

SEQ ID NO: 68628 - RNA, 21 nt, Artificial Sequence
  Sorbitol dehydrogenase (58-64)
ggcaacuucaucgugaagaaa

SEQ ID NO: 68629 - RNA, 63 nt, Artificial Sequence
  Fibrillin-2 (463-483)
ggcaacggguucagccccggaguggguggcgccggggucggagcuggcggucaggggccuauc

SEQ ID NO: 68630 - RNA, 63 nt, Artificial Sequence
  Cytochrome c oxidase subunit 6A1, mitochondrial (66-86)
ggcaaccacacccuguuccauaauccccacgugaacccucucccaacaggguacgaggacgaa

SEQ ID NO: 68631 - RNA, 27 nt, Artificial Sequence
  Tyrosine-protein phosphatase non-receptor type substrate 1 (5-13)
ggccccgccccugggagacugggacca

SEQ ID NO: 68632 - RNA, 66 nt, Artificial Sequence
  Heat shock cognate 71 kDa protein (4-25)
ggccccgccguggggaucgaccugggaaccacauacagcugcgucgguguuuuccagcacggcaag

SEQ ID NO: 68633 - RNA, 33 nt, Artificial Sequence; identical to SEQ ID NO: 44406
  Kinesin-like protein KIF13A (1193-1203)

SEQ ID NO: 68634 - RNA, 51 nt, Artificial Sequence
  Myosin-IIIb (1132-1148)
ggcccccacagcccuguggccgcugggaccagaggauccgcagagguccag

SEQ ID NO: 68635 - RNA, 30 nt, Artificial Sequence
  Obscurin (6240-6249)
ggccccaaggccccugggccaagcaccgga

SEQ ID NO: 68636 - RNA, 36 nt, Artificial Sequence
  Collagen alpha-2(XI) chain (739-750)
ggccccaagggggccaaaggagcuaccgguccuggc

SEQ ID NO: 68637 - RNA, 39 nt, Artificial Sequence
  Collagen alpha-1(III) chain (660-672)
ggccccaagggggacgccggagcuccuggugcaccaggc

SEQ ID NO: 68638 - RNA, 27 nt, Artificial Sequence
  Synaptic vesicle membrane protein VAT-1 homolog (289-297)
ggccccaagagaaaccugauggcccuc

SEQ ID NO: 68639 - RNA, 48 nt, Artificial Sequence
  Fibronectin isoform 6 (1673-1688)
ggccccaugaaggagaucaaccuggccccugacagcuccucugugguc

SEQ ID NO: 68640 - RNA, 51 nt, Artificial Sequence
  Fibronectin isoform 6 (1673-1689)
ggccccaugaaggagaucaaccuggccccugacagcuccucuguggucguu

SEQ ID NO: 68641 - RNA, 36 nt, Artificial Sequence
  Histone acetyltransferase p300 (672-683)
ggccccaacauggggcagccucaaccaggaaugacc

SEQ ID NO: 68642 - RNA, 51 nt, Artificial Sequence
  Collagen alpha-3(IV) chain (637-653)
ggccccccuggggaggccggaccaagaggugaacugagcguguccaccccg

SEQ ID NO: 68643 - RNA, 36 nt, Artificial Sequence
  Collagen alpha-1(III) chain (43-54)
ggccccccugggccagccggaaacaccggugcuccg

SEQ ID NO: 68644 - RNA, 30 nt, Artificial Sequence
  ETS translocation variant 5 (359-368)
ggccccccuuaccagagaagggggagccug

SEQ ID NO: 68645 - RNA, 45 nt, Artificial Sequence
  REST corepressor 2 (504-518)
ggcccccagccuccaccgacccugaucgggacaccccucgagccu

SEQ ID NO: 68646 - RNA, 27 nt, Artificial Sequence
  Cathepsin D (303-311)
ggccccguggacgaggucagagaacug

SEQ ID NO: 68647 - RNA, 48 nt, Artificial Sequence
  Collagen alpha-1(V) chain (1225-1240)
ggccccguggggcugcagggacucccugguccaccgggcgagaagggg

SEQ ID NO: 68648 - RNA, 21 nt, Artificial Sequence
  Barrier-to-autointegration factor (47-53)
ggccaguuccuggugcucaag

SEQ ID NO: 68649 - RNA, 51 nt, Artificial Sequence
  Filamin-A (1240-1256)
ggccaggggguguucagagaggccaccacagaauuuagcgucgacgcuagg

SEQ ID NO: 68650 - RNA, 30 nt, Artificial Sequence
  UHRF1-binding protein 1-like (784-793)
ggccagaagcccagcuccucugacaccuuc

SEQ ID NO: 68651 - RNA, 30 nt, Artificial Sequence; identical to SEQ ID NO: 44424
  Pleckstrin homology-like domain family B member 1 (354-363)

SEQ ID NO: 68652 - RNA, 27 nt, Artificial Sequence
  Transcription elongation factor SPT5 (995-1003)
ggccagaccggggugaucagaagcguc

SEQ ID NO: 68653 - RNA, 27 nt, Artificial Sequence
  Protein prune homolog 2 (1236-1244)
ggccagguggagaucgucaccaagguu

SEQ ID NO: 68654 - RNA, 27 nt, Artificial Sequence
  E3 SUMO-protein ligase RanBP2 (112-120)
ggcagagccaaguacuggcuggagagg

SEQ ID NO: 68655 - RNA, 27 nt, Artificial Sequence
  Hemicentin-1 (3137-3145)
ggcagagacgauaagaacuuccaccug

SEQ ID NO: 68656 - RNA, 114 nt, Artificial Sequence
  DnaJ homolog subfamily B member 11 (23-60)
ggcagagacuucuacaagauccugggggugcccaggagcgccuccauuaaagauauaaagaaagcuuaucggaagcucgcacuucagcugcacccugaccgcaacccagaugac

SEQ ID NO: 68657 - RNA, 27 nt, Artificial Sequence
  Integrin alpha-X (519-527)
ggcagauucggggccgcucugaccgug

SEQ ID NO: 68658 - RNA, 27 nt, Artificial Sequence
  Phosphorylase b kinase regulatory subunit alpha, skeletal muscle isoform (1123-1131)
ggcagauucgggaccaugacauaccug

SEQ ID NO: 68659 - RNA, 27 nt, Artificial Sequence
  Glycerol-3-phosphate acyltransferase 4 (81-89)
ggcagauucaaggaguuuaugagcaaa

SEQ ID NO: 68660 - RNA, 27 nt, Artificial Sequence
  Tyrosine-protein phosphatase non-receptor type 21 (1024-1032)
ggcagauucaagaucaccacaagguuu

SEQ ID NO: 68661 - RNA, 27 nt, Artificial Sequence
  Hemicentin-1 (2532-2540)
ggcagauuccugcagaucaccaacgug

SEQ ID NO: 68662 - RNA, 27 nt, Artificial Sequence
  40S ribosomal protein S21 (44-52)
ggcagauucaacgggcaguuuaagacc

SEQ ID NO: 68663 - RNA, 27 nt, Artificial Sequence
  Serine/threonine-protein kinase WNK1 (228-236)
ggcagagggagcuucaagaccguguac

SEQ ID NO: 68664 - RNA, 30 nt, Artificial Sequence
  Homeodomain-interacting protein kinase 1 (197-206)
ggcagagggaccuucggacagguggccaag

SEQ ID NO: 68665 - RNA, 27 nt, Artificial Sequence
  Exosome component 10 (399-407)
ggcagacacagccuggaccaucuccuu

SEQ ID NO: 68666 - RNA, 27 nt, Artificial Sequence
  Eukaryotic translation initiation factor 3 subunit L (261-269)
ggcagacacagccuguacaagaugcuc

SEQ ID NO: 68667 - RNA, 30 nt, Artificial Sequence
  Hemicentin-1 (305-314)
ggcagacacagcgugaggaucaccgggcug

SEQ ID NO: 68668 - RNA, 27 nt, Artificial Sequence
  Sulfiredoxin-1 (29-37)
ggcagaaucgccgcugugcacaacguc

SEQ ID NO: 68669 - RNA, 27 nt, Artificial Sequence
  FH2 domain-containing protein 1 (1122-1130)
ggcagaauccugaacccccucaggaag

SEQ ID NO: 68670 - RNA, 78 nt, Artificial Sequence
  40S ribosomal protein S19 (120-145)
ggcagaaagcugaccccccaggggcaaagggaccucgaucggaucgccggacagguggcugcagccaacaaaaagcac

SEQ ID NO: 68671 - RNA, 27 nt, Artificial Sequence
  Plectin (581-589)
ggcagacuggaccuccaguacgccaag

SEQ ID NO: 68672 - RNA, 27 nt, Artificial Sequence
  Chondroitin sulfate proteoglycan 4 (2121-2129)
ggcagacuggggcucgaggugggaagg

SEQ ID NO: 68673 - RNA, 27 nt, Artificial Sequence
  CDK-activating kinase assembly factor MAT1 (225-233)
ggcagacugggguaccucaaccacgug

SEQ ID NO: 68674 - RNA, 27 nt, Artificial Sequence
  Coiled-coil domain-containing protein 85B (43-51)
ggcagacugaugcaggaggugaacagg

SEQ ID NO: 68675 - RNA, 30 nt, Artificial Sequence
  Up-regulator of cell proliferation (625-634)
ggcagacugcccgccgggcagaggcgguuc

SEQ ID NO: 68676 - RNA, 27 nt, Artificial Sequence
  Pleckstrin homology-like domain family B member 1 (536-544)
ggcagacugagccccgccuacucccuc

SEQ ID NO: 68677 - RNA, 27 nt, Artificial Sequence
  Muscleblind-like protein 3 (34-42)
ggcagaaacaaucugauccagcaaaag

SEQ ID NO: 68678 - RNA, 30 nt, Artificial Sequence
  L-dopachrome tautomerase (313-322)
ggcagaaacagcaugaagcugcccacccuc

SEQ ID NO: 68679 - RNA, 33 nt, Artificial Sequence
  Probable ATP-dependent RNA helicase DDX17 (123-133)
ggcagaagcucccagucuucaagucaacaguuc

SEQ ID NO: 68680 - RNA, 27 nt, Artificial Sequence
  DNA-dependent protein kinase catalytic subunit (2721-2729)
ggcagaaccgaccugcucaggcuucgg

SEQ ID NO: 68681 - RNA, 27 nt, Artificial Sequence
  Alpha-1,3-mannosyl-glycoprotein 4-beta-N-acetylglucosaminyltransferase B (36-44)
ggcagaaccggggugagcgucguuaug

SEQ ID NO: 68682 - RNA, 27 nt, Artificial Sequence
  Ubiquitin-associated protein 2-like (711-719)
ggcagaaccagcacauccacucugcuc

SEQ ID NO: 68683 - RNA, 27 nt, Artificial Sequence
  Multidrug resistance protein 1 (515-523)
ggcagaaccacaaucgugauugcccac

SEQ ID NO: 68684 - RNA, 30 nt, Artificial Sequence
  Transmembraneoprotein NMB (76-85)
ggcagagugcaggccguccugaccagcgac

SEQ ID NO: 68685 - RNA, 27 nt, Artificial Sequence
  DNA-directed RNA polymerase III subunit RPC4 (335-343)
ggcagagugcagcugcuccuugggaag

SEQ ID NO: 68686 - RNA, 27 nt, Artificial Sequence
  Retinoic acid-induced protein 1 (110-118)
ggcagauacgccggggaggaaagccug

SEQ ID NO: 68687 - RNA, 39 nt, Artificial Sequence
  CD44 antigen (40-52)
ggcagauacagcaucuccaggaccgaggccgcugaccug

SEQ ID NO: 68688 - RNA, 54 nt, Artificial Sequence
  Cytochrome c oxidase subunit 7C, mitochondrial (46-63)
ggcagcgccuucgcuacccccuuucugguggucagacaccagcuccuuaagaca

SEQ ID NO: 68689 - RNA, 39 nt, Artificial Sequence
  Vimentin (41-53)
ggcagcgcccugagacccuccaccucuaggucacucuac

SEQ ID NO: 68690 - RNA, 27 nt, Artificial Sequence
  WD repeat-containing protein 81 (728-736)
ggcagcgacaacggggugaucagacug

SEQ ID NO: 68691 - RNA, 30 nt, Artificial Sequence; identical to SEQ ID NO: 44464
  Protein-methionine sulfoxide oxidase MICAL1 (594-603)

SEQ ID NO: 68692 - RNA, 36 nt, Artificial Sequence
  A-kinase anchor protein 8 (159-170)
ggcagcgacagaaacggguccuucggaggucaguac

SEQ ID NO: 68693 - RNA, 30 nt, Artificial Sequence
  Plasminogen activator inhibitor 1 RNA-binding protein (114-123)
ggcagcgacagauccucuuucucacacuac

SEQ ID NO: 68694 - RNA, 36 nt, Artificial Sequence
  Retinoic acid-induced protein 1 (520-531)
ggcagcgaggacccccuggaaagauccuuccucuac

SEQ ID NO: 68695 - RNA, 27 nt, Artificial Sequence
  Ribosomal protein S6 kinase alpha-6 (82-90)
ggcagcuucgggaagguguuucugguc

SEQ ID NO: 68696 - RNA, 33 nt, Artificial Sequence
  V-type proton ATPase subunit H (179-189)
ggcagcgggguggccgucgagaccggaacaguu

SEQ ID NO: 68697 - RNA, 42 nt, Artificial Sequence
  HLA class I histocompatibility antigen, A-1 alpha chain (25-38)
ggcagccacuccaugagauacuucuuuaccucugugucaagg

SEQ ID NO: 68698 - RNA, 45 nt, Artificial Sequence
  HLA class I histocompatibility antigen, A-1 alpha chain (25-39)
ggcagccacuccaugagauacuucuuuaccucugugucaaggccc

SEQ ID NO: 68699 - RNA, 51 nt, Artificial Sequence
  HLA class I histocompatibility antigen, A-1 alpha chain (25-41)
ggcagccacuccaugagauacuucuuuaccucugugucaaggcccgggcgg

SEQ ID NO: 68700 - RNA, 54 nt, Artificial Sequence
  HLA class I histocompatibility antigen, A-1 alpha chain (25-42)
ggcagccacuccaugagauacuucuuuaccucugugucaaggcccgggcgggga

SEQ ID NO: 68701 - RNA, 78 nt, Artificial Sequence
  HLA class I histocompatibility antigen, A-1 alpha chain (25-50)
ggcagccacuccaugagauacuucuuuaccucugugucaaggcccgggcggggagagccucgcuucaucgccgucggu

SEQ ID NO: 68702 - RNA, 87 nt, Artificial Sequence
  HLA class I histocompatibility antigen, A-1 alpha chain (25-53)
ggcagccacuccaugagauacuucuuuaccucugugucaaggcccgggcggggagagccucgcuucaucgccgucgguuauguugac

SEQ ID NO: 68703 - RNA, 111 nt, Artificial Sequence
  HLA class I histocompatibility antigen, A-1 alpha chain (25-61)
ggcagccacuccaugagauacuucuuuaccucugugucaaggcccgggcggggagagccucgcuucaucgccgucgguuauguugacgauacacaguuugugcgauucgac

SEQ ID NO: 68704 - RNA, 117 nt, Artificial Sequence
  HLA class I histocompatibility antigen, A-1 alpha chain (25-63)
ggcagccacuccaugagauacuucuuuaccucugugucaaggcccgggcggggagagccucgcuucaucgccgucgguuauguugacgauacacaguuugugcgauucgacagugau

SEQ ID NO: 68705 - RNA, 48 nt, Artificial Sequence
  HLA class I histocompatibility antigen, A-23 alpha chain (25-40)
ggcagccacuccaugagauacuucucuaccucagugaguaggcccggg

SEQ ID NO: 68706 - RNA, 54 nt, Artificial Sequence
  HLA class I histocompatibility antigen, A-23 alpha chain (25-42)
ggcagccacuccaugagauacuucucuaccucagugaguaggcccgggcgggga

SEQ ID NO: 68707 - RNA, 57 nt, Artificial Sequence
  HLA class I histocompatibility antigen, A-23 alpha chain (25-43)
ggcagccacuccaugagauacuucucuaccucagugaguaggcccgggcggggagag

SEQ ID NO: 68708 - RNA, 63 nt, Artificial Sequence
  HLA class I histocompatibility antigen, A-23 alpha chain (25-45)
ggcagccacuccaugagauacuucucuaccucagugaguaggcccgggcggggagagccucgc

SEQ ID NO: 68709 - RNA, 78 nt, Artificial Sequence
  HLA class I histocompatibility antigen, A-23 alpha chain (25-50)
ggcagccacuccaugagauacuucucuaccucagugaguaggcccgggcggggagagccucgcuuuaucgccgucggu

SEQ ID NO: 68710 - RNA, 87 nt, Artificial Sequence
  HLA class I histocompatibility antigen, A-23 alpha chain (25-53)
ggcagccacuccaugagauacuucucuaccucagugaguaggcccgggcggggagagccucgcuuuaucgccgucgguuauguugac

SEQ ID NO: 68711 - RNA, 90 nt, Artificial Sequence
  HLA class I histocompatibility antigen, A-23 alpha chain (25-54)
ggcagccacuccaugagauacuucucuaccucagugaguaggcccgggcggggagagccucgcuuuaucgccgucgguuauguugacgau

SEQ ID NO: 68712 - RNA, 108 nt, Artificial Sequence
  HLA class I histocompatibility antigen, A-23 alpha chain (25-60)
ggcagccacuccaugagauacuucucuaccucagugaguaggcccgggcggggagagccucgcuuuaucgccgucgguuauguugacgauacacaguucgugcgauuu

SEQ ID NO: 68713 - RNA, 111 nt, Artificial Sequence
  HLA class I histocompatibility antigen, A-23 alpha chain (25-61)
ggcagccacuccaugagauacuucucuaccucagugaguaggcccgggcggggagagccucgcuuuaucgccgucgguuauguugacgauacacaguucgugcgauuugac

SEQ ID NO: 68714 - RNA, 117 nt, Artificial Sequence
  HLA class I histocompatibility antigen, A-23 alpha chain (25-63)
ggcagccacuccaugagauacuucucuaccucagugaguaggcccgggcggggagagccucgcuuuaucgccgucgguuauguugacgauacacaguucgugcgauuugacagcgau

SEQ ID NO: 68715 - RNA, 111 nt, Artificial Sequence
  HLA class I histocompatibility antigen, B-39 alpha chain (25-61)
ggcagccacuccaugagauacuucuauaccucugugucaaggcccgggcggggagagccucgcuuuaucagugucgguuacguugacgauacacaguucgugcgauuugac

SEQ ID NO: 68716 - RNA, 117 nt, Artificial Sequence
  HLA class I histocompatibility antigen, B-39 alpha chain (25-63)
ggcagccacuccaugagauacuucuauaccucugugucaaggcccgggcggggagagccucgcuuuaucagugucgguuacguugacgauacacaguucgugcgauuugacagcgau

SEQ ID NO: 68717 - RNA, 24 nt, Artificial Sequence
  Inosine-5'-monophosphate dehydrogenase 1 (142-149)
ggcagcaagcugguggggaucguc

SEQ ID NO: 68718 - RNA, 42 nt, Artificial Sequence
  Leucine-tRNA ligase, cytoplasmic (286-299)
ggcagcaugcccgagcugaagaaauacaugaagaaagugaug

SEQ ID NO: 68719 - RNA, 48 nt, Artificial Sequence
  Beta-secretase 2 (112-127)
ggcagcuccaacuucgccguggcugggaccccccacucuuacaucgac

SEQ ID NO: 68720 - RNA, 51 nt, Artificial Sequence
  Beta-secretase 2 (112-128)
ggcagcuccaacuucgccguggcugggaccccccacucuuacaucgacaca

SEQ ID NO: 68721 - RNA, 54 nt, Artificial Sequence
  Keratin, type II cytoskeletal 71 (27-44)
ggcagcuccucuucauucagagccgggaguaagggacugagcgguggcuuuggg

SEQ ID NO: 68722 - RNA, 27 nt, Artificial Sequence
  PH-interacting protein (339-347)
ggcagcaccgaccacaucauuagagug

SEQ ID NO: 68723 - RNA, 27 nt, Artificial Sequence
  WD repeat-containing protein 48 (104-112)
ggcagcaccgagaaggugcugagaguc

SEQ ID NO: 68724 - RNA, 27 nt, Artificial Sequence
  Interferon-induced protein with tetratricopeptide repeats 1 (265-273)
ggcagcguggacaaggcccuggagcuc

SEQ ID NO: 68725 - RNA, 27 nt, Artificial Sequence
  Polyadenylate-binding protein 2 (223-231)
ggcagcgugaacagagucaccauccug

SEQ ID NO: 68726 - RNA, 33 nt, Artificial Sequence
  Immunoglobulin superfamily member 8 (138-148)
ggcagcuacuccgggaagguggagcugagaguc

SEQ ID NO: 68727 - RNA, 72 nt, Artificial Sequence
  HLA class I histocompatibility antigen, A-23 alpha chain (342-365)
ggcagcuacucccaggccgcuucuucagacagugcacaagggagcgaugugucccugaccgccugcaagguc

SEQ ID NO: 68728 - RNA, 72 nt, Artificial Sequence
  HLA class I histocompatibility antigen, A-1 alpha chain (317-340)
ggcagcuacacccaggccgcuuccucugacucagcacaagggagugaugugagccugacagccugcaagguc

SEQ ID NO: 68729 - RNA, 27 nt, Artificial Sequence
  Myelin proteolipid protein (19-27)
ggcaccgccagcuucuuuuuccuguac

SEQ ID NO: 68730 - RNA, 33 nt, Artificial Sequence
  Hemicentin-1 (688-698)
ggcaccgacaagcagaacagcacacugagauac

SEQ ID NO: 68731 - RNA, 27 nt, Artificial Sequence
  Chondroitin sulfate proteoglycan 4 (1612-1620)
ggcaccgacccccagcugcuccuuuac

SEQ ID NO: 68732 - RNA, 24 nt, Artificial Sequence
  Cathepsin F (454-461)
ggcaccgacuggggggagaaggga

SEQ ID NO: 68733 - RNA, 30 nt, Artificial Sequence
  Cathepsin F (454-463)
ggcaccgacuggggggagaagggauacuau

SEQ ID NO: 68734 - RNA, 33 nt, Artificial Sequence
  Cathepsin F (454-464)
ggcaccgacuggggggagaagggauacuauuac

SEQ ID NO: 68735 - RNA, 27 nt, Artificial Sequence
  Cytoplasmic dynein 1 heavy chain 1 (2749-2757)
ggcaccuucaacagagccaugcugagg

SEQ ID NO: 68736 - RNA, 93 nt, Artificial Sequence
  Nucleoporin p58/p45 (64-94)
ggcaccgggcuguucggaagcaagcccgccacagguuuuacucucggcgggacgaacaccggaacaccugcuacuaccuccgcagccacaacc

SEQ ID NO: 68737 - RNA, 27 nt, Artificial Sequence
  DNA damage-binding protein 1 (702-710)
ggcaccaucgacgagauucagaagcug

SEQ ID NO: 68738 - RNA, 30 nt, Artificial Sequence
  60S ribosomal protein L6 (147-156)
ggcaccauccugauuauacucacagggaga

SEQ ID NO: 68739 - RNA, 39 nt, Artificial Sequence
  D-3-phosphoglycerate dehydrogenase (49-61)
ggcaccauccaggugauuacacaagggacuagccugaag

SEQ ID NO: 68740 - RNA, 27 nt, Artificial Sequence
  Hexokinase-1 (535-543)
ggcaccaacuucagagugcugcucguc

SEQ ID NO: 68741 - RNA, 27 nt, Artificial Sequence
  Calponin-3 (207-215)
ggcaccaacaagguggccagccagaaa

SEQ ID NO: 68742 - RNA, 30 nt, Artificial Sequence
  Tripeptidyl-peptidase 1 (306-315)
ggcacccccaacuucccugcccugcucaag

SEQ ID NO: 68743 - RNA, 27 nt, Artificial Sequence
  Histone-lysine N-methyltransferase ASH1L (311-319)
ggcaccacagccguguucaucaacaag

SEQ ID NO: 68744 - RNA, 27 nt, Artificial Sequence
  L-dopachrome tautomerase (301-309)
ggcaccuacgaggggcugcucagaagg

SEQ ID NO: 68745 - RNA, 132 nt, Artificial Sequence
  Cytochrome c oxidase subunit 6C (32-75)
ggcguggccgcucuguacaaguucagagucgcagaccagaggaaaaaggccuaugcggauuuuuaccggaacuaugacguuaugaaagauuucgaggaaaugcgcaaggcugggaucuuucaaagcgugaaa

SEQ ID NO: 68746 - RNA, 45 nt, Artificial Sequence
  Hemicentin-2 (666-680)
ggcguggcccccgaggacgcugggaacuacagcugccaggcaacc

SEQ ID NO: 68747 - RNA, 33 nt, Artificial Sequence
  Unconventional myosin-Ib (244-254)
ggcguggacgaugccgcuaacuucagaaccguc

SEQ ID NO: 68748 - RNA, 48 nt, Artificial Sequence
  Annexin A2 (50-65)
ggcguggacgaggucaccaucguuaacauucugacaaauagaagcaac

SEQ ID NO: 68749 - RNA, 54 nt, Artificial Sequence
  Annexin A2 (50-67)
ggcguggacgaggucaccaucguuaacauucugacaaauagaagcaacgcccag

SEQ ID NO: 68750 - RNA, 27 nt, Artificial Sequence
  Complement C3 (1424-1432)
ggcguggacagauacaucagcaaguau

SEQ ID NO: 68751 - RNA, 27 nt, Artificial Sequence
  Biotinidase (443-451)
ggcguguucgacgggcugcacaccguc

SEQ ID NO: 68752 - RNA, 27 nt, Artificial Sequence
  T-cell immunomodulatory protein (25-33)
ggcguggggcccgucccugccagagcu

SEQ ID NO: 68753 - RNA, 27 nt, Artificial Sequence
  CD109 antigen (187-195)
ggcgugaucagcaagaccuuccagcug

SEQ ID NO: 68754 - RNA, 27 nt, Artificial Sequence
  Zinc finger CCCH domain-containing protein 14 (68-76)
ggcgugcuggacaagcucagaagcguc

SEQ ID NO: 68755 - RNA, 33 nt, Artificial Sequence; identical to SEQ ID NO: 44528
  Probable E3 ubiquitin-protein ligase HERC1 (3840-3850)

SEQ ID NO: 68756 - RNA, 57 nt, Artificial Sequence
  Glia-derived nexin (188-206)
ggcgugcugaccagacucguccuuguuaacgccguguacuucaaggggcuguggaaa

SEQ ID NO: 68757 - RNA, 24 nt, Artificial Sequence
  Nucleolar RNA helicase 2 (421-428)
ggcgugcuggucgccaccaacguu

SEQ ID NO: 68758 - RNA, 39 nt, Artificial Sequence
  Neuronal cell adhesion molecule (398-410)
ggcgugcccaucgagauugccccugacgauccaagcaga

SEQ ID NO: 68759 - RNA, 42 nt, Artificial Sequence
  Neuronal cell adhesion molecule (398-411)
ggcgugcccaucgagauugccccugacgauccaagcagaaag

SEQ ID NO: 68760 - RNA, 72 nt, Artificial Sequence
  Heat shock cognate 71 kDa protein (470-493)
ggcgugccccagaucgaggucaccuucgacauugaugccaacgggauacugaauguuagcgcuguggacaag

SEQ ID NO: 68761 - RNA, 102 nt, Artificial Sequence
  Apolipoprotein L1 (146-179)
ggcgugcagaagguccacaaagggaccacaaucgccaacguugugagcggaucccugucuauuucaagugguauacucacucuuguaggcauggggcuggcu

SEQ ID NO: 68762 - RNA, 27 nt, Artificial Sequence
  Ropporin-1B (131-139)
ggcgugaccaucacaaagacucugaaa

SEQ ID NO: 68763 - RNA, 27 nt, Artificial Sequence
  Alpha-synuclein (47-55)
ggcgugguccacgggguugccaccgug

SEQ ID NO: 68764 - RNA, 30 nt, Artificial Sequence
  Melanoma-associated antigen C2 (257-266)
ggcguguacgccgggagagagcacuucguc

SEQ ID NO: 68765 - RNA, 141 nt, Artificial Sequence
  Protein CDV3 homolog (167-213)
ggcguguacagacccccuggggccaggcugaccacaacucggaagacgccacagggaccgcccgagaucuauagcgacacccaauucccuucccuccagucuacagcuaaacacgucgaaucacgcaaccgauaccuuaag

SEQ ID NO: 68766 - RNA, 27 nt, Artificial Sequence
  Procollagen-lysine,2-oxoglutarate 5-dioxygenase 1 (159-167)
ggcuacgcccccaaccugagcaagcuc

SEQ ID NO: 68767 - RNA, 45 nt, Artificial Sequence
  Interferon alpha-inducible protein 6 (116-130)
ggcuacgccacccacaaguaucuggacagcgaggaagaugaggaa

SEQ ID NO: 68768 - RNA, 48 nt, Artificial Sequence
  HLA class I histocompatibility antigen, B-44 alpha chain (136-151)
ggcuacgaccaggaugccuaugacgggaaggauuacaucgcucugaac

SEQ ID NO: 68769 - RNA, 27 nt, Artificial Sequence
  Alpha-parvin (305-313)
ggcuacuucgugccccugcacagcuuu

SEQ ID NO: 68770 - RNA, 30 nt, Artificial Sequence
  Keratin, type II cytoskeletal 3 (100-109)
ggcuacgggggagguuucggcgggggauuu

SEQ ID NO: 68771 - RNA, 48 nt, Artificial Sequence
  HLA class I histocompatibility antigen, A-2 alpha chain (111-126)
ggcuaccaccaguaugccuacgacgggaaggauuauaucgcucugaaa

SEQ ID NO: 68772 - RNA, 48 nt, Artificial Sequence
  Laminin subunit gamma-1 (666-681)
ggcuaccuggacgaugugacccucgccagcgcuagacccgggccugga

SEQ ID NO: 68773 - RNA, 33 nt, Artificial Sequence
  Unconventional myosin-XVIIIa (1111-1121)
ggcuaccccgaccacaugguguucagcgaguuu

SEQ ID NO: 68774 - RNA, 27 nt, Artificial Sequence
  Heterogeneous nuclear ribonucleoprotein U-like protein 1 (231-239)
ggcuacccccugaccaucgagggguuc

SEQ ID NO: 68775 - RNA, 30 nt, Artificial Sequence
  Spectrin beta chain, non-erythrocytic 1 (189-198)
ggcuaccccaacgugaauauccacaacuuc

SEQ ID NO: 68776 - RNA, 27 nt, Artificial Sequence
  FERM domain-containing protein 5 (67-75)
ggcuacagcuccaaguuccaguuuuuc

SEQ ID NO: 68777 - RNA, 60 nt, Artificial Sequence
  L-lactate dehydrogenase B chain (247-266)
ggcuacaccaacugggccaucgggcugagcguggcugaccucauugaguccaugcuuaag

SEQ ID NO: 68778 - RNA, 60 nt, Artificial Sequence
  L-lactate dehydrogenase A chain (275-294)
ggcuacaccagcugggccaucgggcuguccguggcugaccucgcagagucuauuaugaag

SEQ ID NO: 68779 - RNA, 27 nt, Artificial Sequence
  Beta-hexosaminidase subunit alpha (369-377)
ggcuacguggucuggcaggagguuuuc

SEQ ID NO: 68780 - RNA, 27 nt, Artificial Sequence
  Nestin (55-63)
cacgccgacgaugagcuggcugcacuc

SEQ ID NO: 68781 - RNA, 27 nt, Artificial Sequence
  Centrosomal protein C10orf90 (226-234)
cacgccgacgauaaggagaccagcuuc

SEQ ID NO: 68782 - RNA, 27 nt, Artificial Sequence
  Sentrin-specific protease 6 (139-147)
cacgcccaugcucagauccccgugguc

SEQ ID NO: 68783 - RNA, 27 nt, Artificial Sequence
  Sodium/potassium/calcium exchanger 1 (212-220)
cacgccaucacccccagaacaacugug

SEQ ID NO: 68784 - RNA, 24 nt, Artificial Sequence
  Growth/differentiation factor 15 (241-248)
cacgcccagaucaagaccagccug

SEQ ID NO: 68785 - RNA, 27 nt, Artificial Sequence
  Beta-parvin (157-165)
cacgaccugcucagacccaggggcugg

SEQ ID NO: 68786 - RNA, 36 nt, Artificial Sequence
  Kinase D-interacting substrate of 220 kDa (21-32)
cacgagggccccccuagagccccaagcggguacucc

SEQ ID NO: 68787 - RNA, 27 nt, Artificial Sequence
  Sex comb on midleg-like protein 2 (691-699)
cacgagaucgacggcaaggcccuguuc

SEQ ID NO: 68788 - RNA, 27 nt, Artificial Sequence
  Aldehyde dehydrogenase family 1 member A3 (41-49)
cacgagagcaaguccggcaaaaaguuc

SEQ ID NO: 68789 - RNA, 27 nt, Artificial Sequence
  Echinoderm microtubule-associated protein-like 6 (1842-1850)
cacgaggugccccugggcaagcagguc

SEQ ID NO: 68790 - RNA, 18 nt, Artificial Sequence
  Leucine-rich repeat-containing protein 42 (71-76)
cacuucaucuuuaccuac

SEQ ID NO: 68791 - RNA, 45 nt, Artificial Sequence
  Laminin subunit gamma-1 (101-115)
cacggcgccgcuuuccugaccgacuacaacaaucaggcagauaca

SEQ ID NO: 68792 - RNA, 48 nt, Artificial Sequence
  Laminin subunit gamma-1 (101-116)
cacggcgccgcuuuccugaccgacuacaacaaucaggcagauacaacu

SEQ ID NO: 68793 - RNA, 27 nt, Artificial Sequence
  Fibrocystin-L (1809-1817)
caccauagcguguccgucguugugggc

SEQ ID NO: 68794 - RNA, 27 nt, Artificial Sequence
  DIS3-like exonuclease 1 (421-429)
cacaucgccgacgugacccauuucguc

SEQ ID NO: 68795 - RNA, 27 nt, Artificial Sequence
  Protein arginine N-methyltransferase 3 (190-198)
cacaucuucaaggacaaagugguccug

SEQ ID NO: 68796 - RNA, 27 nt, Artificial Sequence
  Carbonic anhydrase 14 (176-184)
cacauccugagccaucuccacgaggug

SEQ ID NO: 68797 - RNA, 27 nt, Artificial Sequence
  Coatomer subunit gamma-2 (46-54)
cacauccugaccaagauucucuaccuu

SEQ ID NO: 68798 - RNA, 27 nt, Artificial Sequence
  Chondroitin sulfate proteoglycan 4 (290-298)
cacaucaacgcccauagacuggagauu

SEQ ID NO: 68799 - RNA, 21 nt, Artificial Sequence
  Mediator of RNA polymerase II transcription subunit 23 (178-184)
cacaucaaccagauuggcuac

SEQ ID NO: 68800 - RNA, 72 nt, Artificial Sequence
  Histidine triad nucleotide-binding protein 1 (59-82)
cacaucagccagauuuccguggccgaggacgaugacgaaucucugcucggccaucuuaugauagucgggaag

SEQ ID NO: 68801 - RNA, 21 nt, Artificial Sequence
  Thymidylate synthase (256-262)
cacaucuaccugaaccauauu

SEQ ID NO: 68802 - RNA, 27 nt, Artificial Sequence
  Vesicle-trafficking protein SEC22c (208-216)
caccuggccgagcauagccuccaggug

SEQ ID NO: 68803 - RNA, 27 nt, Artificial Sequence
  Leucine-rich repeat-containing protein C10orf11 (68-76)
caccuggccgaggugacccccgcucuc

SEQ ID NO: 68804 - RNA, 33 nt, Artificial Sequence
  Cytochrome c oxidase subunit 1 (151-161)
caccuggccggcgugagcuccauccucggggcu

SEQ ID NO: 68805 - RNA, 27 nt, Artificial Sequence
  Beta-hexosaminidase subunit beta (59-67)
caccuggcccccgagaacuucuacauc

SEQ ID NO: 68806 - RNA, 27 nt, Artificial Sequence
  Zinc finger protein 638 (1613-1621)
caccuggcccaggcucucgugaccguc

SEQ ID NO: 68807 - RNA, 27 nt, Artificial Sequence
  Receptor-interacting serine/threonine-protein kinase 4 (730-738)
caccuggccaccgugaagcuccuuguc

SEQ ID NO: 68808 - RNA, 27 nt, Artificial Sequence
  Unconventional myosin-Ic (1017-1025)
caccuggccguggucgcucccagacuc

SEQ ID NO: 68809 - RNA, 30 nt, Artificial Sequence
  Zinc finger protein 879 (30-39)
caccuggacagcgcccagagagcucucuac

SEQ ID NO: 68810 - RNA, 27 nt, Artificial Sequence
  Vacuolar protein sorting-associated protein 13C (1304-1312)
caccuggacagcaugaacgugucccuc

SEQ ID NO: 68811 - RNA, 27 nt, Artificial Sequence
  Membrane-associated transporter protein (324-332)
caccugaucggcuggaccgccuuccuc

SEQ ID NO: 68812 - RNA, 24 nt, Artificial Sequence
  Neutral alpha-glucosidase AB (77-84)
caccugauccaugaggugaccaag

SEQ ID NO: 68813 - RNA, 27 nt, Artificial Sequence
  Polypeptide N-acetylgalactosaminyltransferase 2 (166-174)
caccugaucaaggagauuauacucgug

SEQ ID NO: 68814 - RNA, 33 nt, Artificial Sequence
  Myomegalin (201-211)
caccugcucgaggaacccaccagcauggaggug

SEQ ID NO: 68815 - RNA, 27 nt, Artificial Sequence
  Transmembrane and TPR repeat-containing protein 3 (93-101)
caccugcucaacaugaucuuccaugcc

SEQ ID NO: 68816 - RNA, 27 nt, Artificial Sequence
  Gamma-tubulin complex component 5 (435-443)
caccugcucaacacccuuuacaaggcc

SEQ ID NO: 68817 - RNA, 27 nt, Artificial Sequence
  RNA-binding protein EWS (499-507)
caccugaacggccauaucaagcaggug

SEQ ID NO: 68818 - RNA, 27 nt, Artificial Sequence
  Triple functional domain protein (852-860)
caccugcaggccgaggugaagcaaguc

SEQ ID NO: 68819 - RNA, 27 nt, Artificial Sequence
  Eukaryotic translation initiation factor 3 subunit C-like protein (594-602)
caccugcaggacaacauccaacaugcc

SEQ ID NO: 68820 - RNA, 51 nt, Artificial Sequence
  Histone H2A.V (60-76)
caccugcagcucgccaucagaggcgacgaggaacuugauagccugauuaag

SEQ ID NO: 68821 - RNA, 27 nt, Artificial Sequence
  Inhibitor of nuclear factor kappa-B kinase subunit alpha (688-696)
caccugagcaccaucauucaugaggcc

SEQ ID NO: 68822 - RNA, 27 nt, Artificial Sequence
  Protein TANC1 (1149-1157)
caccugagcaccguggaguuccuccuu

SEQ ID NO: 68823 - RNA, 27 nt, Artificial Sequence
  Pre-mRNA-splicing factor ATP-dependent RNA helicase PRP16 (1008-1016)
caccugaccuaccucaacguguaucuu

SEQ ID NO: 68824 - RNA, 30 nt, Artificial Sequence
  ATPase family AAA domain-containing protein 1 (79-88)
caccugguggacccccucaacaugcauguc

SEQ ID NO: 68825 - RNA, 27 nt, Artificial Sequence
  Dedicator of cytokinesis protein 1 (422-430)
caccugguggacagaaccacagccguc

SEQ ID NO: 68826 - RNA, 27 nt, Artificial Sequence
  Putative inactive carbonic anhydrase 5B-like protein (29-37)
caccuggugcauuggaacgccgucaag

SEQ ID NO: 68827 - RNA, 27 nt, Artificial Sequence
  UDP-galactose translocator (109-117)
caccuggugcucuuccuucaugaggcc

SEQ ID NO: 68828 - RNA, 27 nt, Artificial Sequence
  Tonsoku-like protein (37-45)
caccuguacgaggaccucuucagagcc

SEQ ID NO: 68829 - RNA, 27 nt, Artificial Sequence
  Alpha/beta hydrolase domain-containing protein 13 (38-46)
caccuguacggcgggaucauucuccuu

SEQ ID NO: 68830 - RNA, 27 nt, Artificial Sequence
  Interferon-related developmental regulator 1 (373-381)
caccuguacaacagcgccgcuuucaag

SEQ ID NO: 68831 - RNA, 18 nt, Artificial Sequence
  Bax inhibitor 1 (94-99)
cacauggugacccauuuc

SEQ ID NO: 68832 - RNA, 27 nt, Artificial Sequence
  Eukaryotic translation initiation factor 3 subunit C-like protein (433-441)
cacaacgccgaccagccccugagagug

SEQ ID NO: 68833 - RNA, 45 nt, Artificial Sequence
  Tartrate-resistant acid phosphatase type 5 (240-254)
cacaaccugcaguaccuccaagacgagaauggcgugggguauguc

SEQ ID NO: 68834 - RNA, 27 nt, Artificial Sequence
  GMP synthase (glutamine-hydrolyzing) (555-563)
cacaacgugaauagagucguuuacauc

SEQ ID NO: 68835 - RNA, 24 nt, Artificial Sequence
  60S ribosomal protein L10 (92-99)
caccccuuccaugugaucagaauu

SEQ ID NO: 68836 - RNA, 27 nt, Artificial Sequence
  Protein EURL homolog (214-222)
cacccccauuacagcagagaggaacug

SEQ ID NO: 68837 - RNA, 27 nt, Artificial Sequence
  Porphobilinogen deaminase (109-117)
caccccaaguucgugggcaaaacccug

SEQ ID NO: 68838 - RNA, 30 nt, Artificial Sequence
  Transmembrane protein 209 (465-474)
caccccaaguacccugacggcaaaaccuuc

SEQ ID NO: 68839 - RNA, 27 nt, Artificial Sequence
  WD repeat-containing protein 43 (361-369)
caccccaacagcgccgugcugaugguc

SEQ ID NO: 68840 - RNA, 24 nt, Artificial Sequence
  Angio-associated migratory cell protein (51-58)
caccccagagccccugugcugcuc

SEQ ID NO: 68841 - RNA, 24 nt, Artificial Sequence
  Microtubule-associated proteins 1A/1B light chain 3B (27-34)
caccccaccaagaucccugugauu

SEQ ID NO: 68842 - RNA, 27 nt, Artificial Sequence
  Uncharacterized protein C18orf8 (244-252)
caccccgugcugccugccagaagcauc

SEQ ID NO: 68843 - RNA, 27 nt, Artificial Sequence
  Melanoma-derived growth regulatory protein (65-73)
cacagaggccagguggucuacguuuuc

SEQ ID NO: 68844 - RNA, 27 nt, Artificial Sequence
  Platelet-derived growth factor D (2-10)
cacagacugaucuucguguacacccuc

SEQ ID NO: 68845 - RNA, 24 nt, Artificial Sequence
  Serine protease HTRA1 (143-150)
cacagacccccugugaucguccug

SEQ ID NO: 68846 - RNA, 27 nt, Artificial Sequence
  Asparagine synthetase (glutamine-hydrolyzing) (86-94)
cacagcgccacccccuuccugaaggug

SEQ ID NO: 68847 - RNA, 24 nt, Artificial Sequence
  Histone deacetylase 1 (68-75)
cacagcgacgauuacaucaaguuc

SEQ ID NO: 68848 - RNA, 33 nt, Artificial Sequence
  Histone-lysine N-methyltransferase NSD3 (877-887)
cacagcgaccccauguucuccucuuacgccuau

SEQ ID NO: 68849 - RNA, 27 nt, Artificial Sequence
  Histone deacetylase 9 (697-705)
cacagcgagcaucacucccugcucuac

SEQ ID NO: 68850 - RNA, 42 nt, Artificial Sequence
  Tubulin alpha-1C chain (209-222)
cacagcuucggcgggggaaccgguuccggcuuuacaucucug

SEQ ID NO: 68851 - RNA, 24 nt, Artificial Sequence
  Neuropilin-2 (415-422)
cacagcggcaucgcccugagacuc

SEQ ID NO: 68852 - RNA, 24 nt, Artificial Sequence
  Pre-mRNA-processing factor 19 (391-398)
cacagcggccccaucaccuccauu

SEQ ID NO: 68853 - RNA, 27 nt, Artificial Sequence
  Centrosome-associated protein 350 (1116-1124)
cacagcaucuccauucccaccaagcug

SEQ ID NO: 68854 - RNA, 27 nt, Artificial Sequence
  Serine/threonine-protein kinase MRCK alpha (1363-1371)
cacagcaacgaccauacccuguccuuc

SEQ ID NO: 68855 - RNA, 27 nt, Artificial Sequence
  Heterogeneous nuclear ribonucleoprotein K (187-195)
cacagcaccgacagagugguccugauc

SEQ ID NO: 68856 - RNA, 24 nt, Artificial Sequence
  COP9 signalosome complex subunit 6 (130-137)
cacaccgaccugcccgugagcguc

SEQ ID NO: 68857 - RNA, 42 nt, Artificial Sequence
  Sodium/potassium-transporting ATPase subunit alpha-3 (688-701)
cacaccgagaucguguucgccagaacaagcccccagcaaaag

SEQ ID NO: 68858 - RNA, 45 nt, Artificial Sequence
  Sodium/potassium-transporting ATPase subunit alpha-3 (688-702)
cacaccgagaucguguucgccagaacaagcccccagcaaaagcug

SEQ ID NO: 68859 - RNA, 42 nt, Artificial Sequence
  Tyrosine-protein phosphatase non-receptor type substrate 1 (453-466)
cacaccgaguacgccagcauccagacauccccccaaccugcu

SEQ ID NO: 68860 - RNA, 27 nt, Artificial Sequence
  H(+)/Cl(-) exchange transporter 3 (72-80)
cacaccaucgacugggugagagagaag

SEQ ID NO: 68861 - RNA, 33 nt, Artificial Sequence; identical to SEQ ID NO: 44634
  Tensin-3 (344-354)

SEQ ID NO: 68862 - RNA, 27 nt, Artificial Sequence
  Bifunctional glutamate/proline-tRNA ligase (1093-1101)
cacguggccgacuucgcucccgagguc

SEQ ID NO: 68863 - RNA, 36 nt, Artificial Sequence
  Cytochrome c oxidase subunit 6A1, mitochondrial (75-86)
cacgugaacccccugccuaccggcuacgaggacgaa

SEQ ID NO: 68864 - RNA, 48 nt, Artificial Sequence
  Beta-2-microglobulin (83-98)
cacgugacccugagccagcccaagaucgucaaaugggacagagauaug

SEQ ID NO: 68865 - RNA, 18 nt, Artificial Sequence
  GPI transamidase component PIG-T (164-169)
cacuacuuccugagauau

SEQ ID NO: 68866 - RNA, 24 nt, Artificial Sequence
  Vacuolar protein sorting-associated protein 41 homolog (13-20)
cacuacggcaagguguaucugcuc

SEQ ID NO: 68867 - RNA, 24 nt, Artificial Sequence
  Interferon-induced protein with tetratricopeptide repeats 1 (383-390)
cacuacggcagauuccaggaguuu

SEQ ID NO: 68868 - RNA, 27 nt, Artificial Sequence
  Transcription factor SOX-10 (387-395)
cacuacggcagcgccuuccccuccauc

SEQ ID NO: 68869 - RNA, 27 nt, Artificial Sequence
  AF4/FMR2 family member 4 (917-925)
cacuaccugcaggaggccaagaaacuc

SEQ ID NO: 68870 - RNA, 27 nt, Artificial Sequence
  KN motif and ankyrin repeat domain-containing protein 1 (1167-1175)
cacuacagcgugucccauucuaacuuc

SEQ ID NO: 68871 - RNA, 27 nt, Artificial Sequence
  L-dopachrome tautomerase (189-197)
cacuacuauagcgugagagacacccug

SEQ ID NO: 68872 - RNA, 24 nt, Artificial Sequence
  Brefeldin A-inhibited guanine nucleotide-exchange protein 2 (340-347)
aucgccgacgauagacagagccug

SEQ ID NO: 68873 - RNA, 27 nt, Artificial Sequence
  Tripartite motif-containing protein 44 (270-278)
aucgccgacgaggaacagaaggcucug

SEQ ID NO: 68874 - RNA, 30 nt, Artificial Sequence
  Serine hydroxymethyltransferase, cytosolic (79-88)
aucgccgacgagaacggcgcuuaccugaug

SEQ ID NO: 68875 - RNA, 27 nt, Artificial Sequence
  Vitamin K-dependent gamma-carboxylase (475-483)
aucgccgacuuccccggccugcaccuc

SEQ ID NO: 68876 - RNA, 27 nt, Artificial Sequence
  Chromodomain-helicase-DNA-binding protein 3 (372-380)
aucgccgacggcggguucaccgagcug

SEQ ID NO: 68877 - RNA, 24 nt, Artificial Sequence
  Probable dimethyladenosine transferase (116-123)
aucgccgacaagauucagcaaaua

SEQ ID NO: 68878 - RNA, 24 nt, Artificial Sequence
  Mitotic checkpoint serine/threonine-protein kinase BUB1 beta (956-963)
aucgccgaccuggcucaccuccuu

SEQ ID NO: 68879 - RNA, 27 nt, Artificial Sequence
  Gamma-interferon-inducible protein 16 (48-56)
aucgccgaccugauggaggaaaaguuc

SEQ ID NO: 68880 - RNA, 24 nt, Artificial Sequence
  Ras association domain-containing protein 5 (335-342)
aucgccgacagaccccuguaccuc

SEQ ID NO: 68881 - RNA, 24 nt, Artificial Sequence
  Dolichyl-diphosphooligosaccharide-proteinosyltransferase subunit 2 (268-275)
aucgccgacagccaccagaacuuc

SEQ ID NO: 68882 - RNA, 27 nt, Artificial Sequence
  Consortin (202-210)
aucgccgaggaccccaagguguuccug

SEQ ID NO: 68883 - RNA, 27 nt, Artificial Sequence
  Eukaryotic translation initiation factor 4 gamma 2 (5-13)
aucgccgagggcggggcuagcagauuc

SEQ ID NO: 68884 - RNA, 27 nt, Artificial Sequence
  Tensin-3 (154-162)
aucgccuucagcagacccgugaaguac

SEQ ID NO: 68885 - RNA, 90 nt, Artificial Sequence
  Flavin reductaseADPH) (6-35)
aucgccauuuucggcgcuaccgggcagacaggacugacuacgcucgcacaagccgugcaggcggguuacgaggucaccguucuugugaga

SEQ ID NO: 68886 - RNA, 27 nt, Artificial Sequence
  Ras GTPase-activating-like protein IQGAP2 (219-227)
aucgccauuaacgaggcuguggaaaag

SEQ ID NO: 68887 - RNA, 27 nt, Artificial Sequence
  Ubiquitin carboxyl-terminal hydrolase 15 (259-267)
aucgccaagagcuacgcugagcugauu

SEQ ID NO: 68888 - RNA, 27 nt, Artificial Sequence
  Prolow-density lipoprotein receptor-related protein 1 (1392-1400)
aucgcccuggaccccagagauggcauu

SEQ ID NO: 68889 - RNA, 36 nt, Artificial Sequence
  Transcription factor Sp1 (551-562)
aucgccaacgcucccggcgaccacggggcacagcug

SEQ ID NO: 68890 - RNA, 27 nt, Artificial Sequence
  Dolichyl-diphosphooligosaccharide-proteinosyltransferase subunit 2 (220-228)
aucgccaacaccguggagcugagaguc

SEQ ID NO: 68891 - RNA, 42 nt, Artificial Sequence
  Solute carrier family 2, facilitated glucose transporter member 1 (21-34)
aucgcccagguguucggccuggacagcauuauggggaacaag

SEQ ID NO: 68892 - RNA, 48 nt, Artificial Sequence
  Solute carrier family 2, facilitated glucose transporter member 1 (21-36)
aucgcccagguguucggccuggacagcauuauggggaacaaggaucuc

SEQ ID NO: 68893 - RNA, 24 nt, Artificial Sequence
  60S ribosomal protein L35 (54-61)
aucgccagagugcugaccgucauu

SEQ ID NO: 68894 - RNA, 27 nt, Artificial Sequence
  Alpha-actinin-3 (114-122)
aucgccagcaagggcgugaaacugguc

SEQ ID NO: 68895 - RNA, 27 nt, Artificial Sequence
  Derlin-2 (50-58)
aucgccgugggccacauuuacuucuuu

SEQ ID NO: 68896 - RNA, 21 nt, Artificial Sequence
  Solute carrier family 25 member 35 (138-144)
aucgccgugggccaccaguac

SEQ ID NO: 68897 - RNA, 27 nt, Artificial Sequence
  Ectonucleoside triphosphate diphosphohydrolase 4 (279-287)
aucgccuacgaggugcccaagaccguc

SEQ ID NO: 68898 - RNA, 27 nt, Artificial Sequence
  DNA topoisomerase 3-beta-1 (521-529)
aucugccagagaaacuacgugaccguc

SEQ ID NO: 68899 - RNA, 30 nt, Artificial Sequence
  Zinc transporter ZIP14 (350-359)
aucgacggccuggccauuggggcuagcuuc

SEQ ID NO: 68900 - RNA, 27 nt, Artificial Sequence
  Nucleolin (454-462)
aucgacggcagaagcauuucccuguac

SEQ ID NO: 68901 - RNA, 30 nt, Artificial Sequence
  Nucleolin (454-463)
aucgacggcagaagcauuucccuguacuau

SEQ ID NO: 68902 - RNA, 21 nt, Artificial Sequence
  Keratin, type II cytoskeletal 1b (179-185)
aucgacaaggugagauuccug

SEQ ID NO: 68903 - RNA, 69 nt, Artificial Sequence
  Puromycin-sensitive aminopeptidase (305-327)
aucgaccugauugccauagcugauuucgcagccggcgcgauggagaacugggggcucgugaccuacaga

SEQ ID NO: 68904 - RNA, 27 nt, Artificial Sequence
  Prelamin-A/C (80-88)
aucgacaacggcaagcagagagaguuc

SEQ ID NO: 68905 - RNA, 30 nt, Artificial Sequence
  Structural maintenance of chromosomes flexible hinge domain-containing protein 1 (183-192)
aucgacaacggcagagggaugaccagcaag

SEQ ID NO: 68906 - RNA, 27 nt, Artificial Sequence
  DNA damage-binding protein 1 (794-802)
aucgaccagcacaccuucgaggugcug

SEQ ID NO: 68907 - RNA, 21 nt, Artificial Sequence
  Pre-mRNA-processing-splicing factor 8 (1380-1386)
aucgacagccagagagugugg

SEQ ID NO: 68908 - RNA, 42 nt, Artificial Sequence
  Clathrin heavy chain 1 (1125-1138)
aucgacagcuacauuaaggccgaugaccccuccucuuauaug

SEQ ID NO: 68909 - RNA, 45 nt, Artificial Sequence
  Clathrin heavy chain 1 (1125-1139)
aucgacagcuacauuaaggccgaugaccccuccucuuauauggag

SEQ ID NO: 68910 - RNA, 21 nt, Artificial Sequence
  Talin-1 (292-298)
aucgaggccaaggugagauac

SEQ ID NO: 68911 - RNA, 27 nt, Artificial Sequence
  Microtubule-associated protein 4 (17-25)
aucgagggcgaaauuaagagagacuuc

SEQ ID NO: 68912 - RNA, 27 nt, Artificial Sequence
  Actin, cytoplasmic 2 (71-79)
aucgagcacggcauugugaccaacugg

SEQ ID NO: 68913 - RNA, 18 nt, Artificial Sequence
  Fatty acid desaturase 2 (352-357)
aucgagcaccaucuguuc

SEQ ID NO: 68914 - RNA, 21 nt, Artificial Sequence
  Programmed cell death protein 5 (93-99)
aucgagauucugaagaaagug

SEQ ID NO: 68915 - RNA, 27 nt, Artificial Sequence
  DnaJ homolog subfamily C member 7 (216-224)
aucgagaaggccgugcaguucuuuguc

SEQ ID NO: 68916 - RNA, 21 nt, Artificial Sequence
  Cysteine-rich protein 2-binding protein (156-162)
aucgagaagcacuggaccuuc

SEQ ID NO: 68917 - RNA, 24 nt, Artificial Sequence
  rRNA-processing protein FCF1 homolog (110-117)
aucgagaagcugggccagaaauac

SEQ ID NO: 68918 - RNA, 30 nt, Artificial Sequence
  Lysosomal-trafficking regulator (3604-3613)
aucgagauggaaacccagauucaccuguac

SEQ ID NO: 68919 - RNA, 27 nt, Artificial Sequence
  Cholinesterase (384-392)
aucuucuuucccggcgugagcgaguuc

SEQ ID NO: 68920 - RNA, 27 nt, Artificial Sequence
  Inositol 1,4,5-trisphosphate receptor type 2 (1770-1778)
aucuucagcgagggcauuuuucugggg

SEQ ID NO: 68921 - RNA, 30 nt, Artificial Sequence
  E3 ubiquitin-protein ligase UBR4 (2405-2414)
aucggcgccagcguggaccccgcugggguc

SEQ ID NO: 68922 - RNA, 27 nt, Artificial Sequence
  Mannose-6-phosphate isomerase (121-129)
aucggcgacgaggccgcuacccaccug

SEQ ID NO: 68923 - RNA, 27 nt, Artificial Sequence
  Beta-catenin-like protein 1 (430-438)
aucggcgacgggagaagccccgaguuc

SEQ ID NO: 68924 - RNA, 27 nt, Artificial Sequence
  Fructose-bisphosphate aldolase A (208-216)
aucggcgagcacacccccagcgcccug

SEQ ID NO: 68925 - RNA, 21 nt, Artificial Sequence
  40S ribosomal protein S29 (50-56)
aucggcuucauuaagcuggac

SEQ ID NO: 68926 - RNA, 24 nt, Artificial Sequence
  Transmembrane protein 263 (60-67)
aucggcgggaagagccuggaggug

SEQ ID NO: 68927 - RNA, 30 nt, Artificial Sequence
  RNA-binding Raly-like protein (25-34)
aucggcaaccugaauaccgccauugugaag

SEQ ID NO: 68928 - RNA, 30 nt, Artificial Sequence
  RNA-binding protein Raly (25-34)
aucggcaaccugaauaccgcccucgugaag

SEQ ID NO: 68929 - RNA, 45 nt, Artificial Sequence
  Protocadherin Fat 1 (1606-1620)
aucggcaacagcuucaugauugaccccgugcugggguccauaaag

SEQ ID NO: 68930 - RNA, 45 nt, Artificial Sequence
  Protocadherin Fat 1 (1682-1696)
aucggcagcuucguggggauggucaccgcccacucccagucuuca

SEQ ID NO: 68931 - RNA, 24 nt, Artificial Sequence
  Cilia- and flagella-associated protein 20 (17-24)
aucggcagcaagccccugcagauu

SEQ ID NO: 68932 - RNA, 21 nt, Artificial Sequence
  Retinoblastoma-like protein 1 (197-203)
aucggcacccccagaaaguuc

SEQ ID NO: 68933 - RNA, 72 nt, Artificial Sequence
  Heterogeneous nuclear ribonucleoprotein U (241-264)
aucggcuggagccugaccacauccgggaugcuccuuggagaggaagaguucucuuacgguuauucacugaag

SEQ ID NO: 68934 - RNA, 24 nt, Artificial Sequence
  Zinc finger protein 148 (258-265)
auccaccccccuaagcuggugcuc

SEQ ID NO: 68935 - RNA, 27 nt, Artificial Sequence
  Trifunctional purine biosynthetic protein adenosine-3 (206-214)
auccaccccagccugcucccuuccuuc

SEQ ID NO: 68936 - RNA, 21 nt, Artificial Sequence
  Dedicator of cytokinesis protein 7 (741-747)
auccacuacguguucagacug

SEQ ID NO: 68937 - RNA, 24 nt, Artificial Sequence
  MICOS complex subunit MIC27 (159-166)
aucauugccaaggugaccgcuaaa

SEQ ID NO: 68938 - RNA, 24 nt, Artificial Sequence
  Protein PRRC2C (1659-1666)
aucauugacgaucaccccgaggug

SEQ ID NO: 68939 - RNA, 27 nt, Artificial Sequence
  26S protease regulatory subunit 4 (115-123)
aucauugacgauaaccacgccauagug

SEQ ID NO: 68940 - RNA, 24 nt, Artificial Sequence
  Lambda-crystallin homolog (90-97)
aucauugacgauagagugauacug

SEQ ID NO: 68941 - RNA, 27 nt, Artificial Sequence
  RANBP2-like and GRIP domain-containing protein 1 (712-720)
aucauugacgauagcgacuccaaccug

SEQ ID NO: 68942 - RNA, 27 nt, Artificial Sequence
  Niemann-Pick C1 protein (1094-1102)
aucauugacgauaccauauucaaccug

SEQ ID NO: 68943 - RNA, 27 nt, Artificial Sequence
  Eukaryotic translation initiation factor 3 subunit L (186-194)
aucauugacgaguucauauaccaguuu

SEQ ID NO: 68944 - RNA, 30 nt, Artificial Sequence
  UDP-N-acetylhexosamine pyrophosphorylase (491-500)
aucauugacgagaacggcgugcacgaacug

SEQ ID NO: 68945 - RNA, 27 nt, Artificial Sequence
  Serine/threonine-protein kinase Kist (152-160)
aucauugaccacauauucgccagcaag

SEQ ID NO: 68946 - RNA, 27 nt, Artificial Sequence
  AP-3 complex subunit mu-2 (190-198)
aucauugacaagagcggcuccaccaua

SEQ ID NO: 68947 - RNA, 27 nt, Artificial Sequence
  Caspase recruitment domain-containing protein 19 (143-151)
aucauugacagacacgugagcagguac

SEQ ID NO: 68948 - RNA, 24 nt, Artificial Sequence
  Double-strand-break repair protein rad21 homolog (444-451)
aucauugaggaacccagcagacug

SEQ ID NO: 68949 - RNA, 63 nt, Artificial Sequence
  T-complex protein 1 subunit alpha (160-180)
aucauuggcauaaacggggacuucuuugccaauaugguggucgaugcuguucuggcaaucaag

SEQ ID NO: 68950 - RNA, 27 nt, Artificial Sequence
  Ubiquitin-like modifier-activating enzyme 1 (91-99)
aucauucugggcggggugaaggccguc

SEQ ID NO: 68951 - RNA, 27 nt, Artificial Sequence
  Transportin-1 (757-765)
aucauuaacagacccaauaccccuaag

SEQ ID NO: 68952 - RNA, 27 nt, Artificial Sequence
  Far upstream element-binding protein 1 (359-367)
aucauuaccgaccugcucagaagcgug

SEQ ID NO: 68953 - RNA, 27 nt, Artificial Sequence
  Glycerol-3-phosphate acyltransferase 4 (30-38)
aucauugugcccgccauauucggcguc

SEQ ID NO: 68954 - RNA, 45 nt, Artificial Sequence
  Syntaxin-7 (70-84)
aucaaggaguucggcagccugcccaccacaccuuccgaacagaga

SEQ ID NO: 68955 - RNA, 48 nt, Artificial Sequence
  Alpha-enolase (26-41)
aucaaggagaaauacggcaaggacgccaccaacgugggggaugaagga

SEQ ID NO: 68956 - RNA, 21 nt, Artificial Sequence
  26S proteasome non-ATPase regulatory subunit 8 (133-139)
aucaagcaccccgugagccug

SEQ ID NO: 68957 - RNA, 33 nt, Artificial Sequence
  Keratin, type II cytoskeletal 1 (184-194)
aucaagagccugaacaaucaguucgccuccuuu

SEQ ID NO: 68958 - RNA, 30 nt, Artificial Sequence
  Synaptojanin-1 (895-904)
aucaagagcucccugcccgagaacaauuuc

SEQ ID NO: 68959 - RNA, 69 nt, Artificial Sequence
  Vimentin (444-466)
aucaagaccguggagacaagagacggccaggucauuaacgaaacuagccaacaccaugaugaccuggag

SEQ ID NO: 68960 - RNA, 27 nt, Artificial Sequence
  Talin-1 (862-870)
auccuggccgacgcuaccgcaaagaug

SEQ ID NO: 68961 - RNA, 30 nt, Artificial Sequence
  DNA-dependent protein kinase catalytic subunit (544-553)
auccuggccgacgaggcuuucuuuagcgug

SEQ ID NO: 68962 - RNA, 30 nt, Artificial Sequence
  Exonuclease 3'-5' domain-containing protein 2 (30-39)
auccuggccgacggcaccauucucaaggug

SEQ ID NO: 68963 - RNA, 36 nt, Artificial Sequence
  Globoside alpha-1,3-N-acetylgalactosaminyltransferase 1 (266-277)
auccuggccgacaaggcuaacggcauuauggcagcc

SEQ ID NO: 68964 - RNA, 33 nt, Artificial Sequence
  Catenin alpha-1 (140-150)
auccuggccgacauggcugauguguacaagcuc

SEQ ID NO: 68965 - RNA, 27 nt, Artificial Sequence
  Dynactin subunit 3 (87-95)
auccuggccgaggaacaguucauucuc

SEQ ID NO: 68966 - RNA, 27 nt, Artificial Sequence
  Transmembrane protein 87A (234-242)
auccuggccgagcuccuuagcgcugug

SEQ ID NO: 68967 - RNA, 27 nt, Artificial Sequence
  Serum paraoxonase/arylesterase 2 (239-247)
auccuggcccacgagauucaugugcuc

SEQ ID NO: 68968 - RNA, 27 nt, Artificial Sequence
  Centrosomal protein of 170 kDa protein B (1269-1277)
auccuggcccaggagauucacgacgug

SEQ ID NO: 68969 - RNA, 27 nt, Artificial Sequence
  Unconventional myosin-XV (2127-2135)
auccuggcccagcucgcuaaccaagug

SEQ ID NO: 68970 - RNA, 27 nt, Artificial Sequence
  Multidrug resistance-associated protein 1 (560-568)
auccuggacgcccagaccgcuuucgug

SEQ ID NO: 68971 - RNA, 27 nt, Artificial Sequence
  Unconventional myosin-Id (455-463)
auccuggacgaugccugcaugaacgug

SEQ ID NO: 68972 - RNA, 27 nt, Artificial Sequence
  Acyl-CoA synthetase short-chain family member 3, mitochondrial (486-494)
auccuggacgauaacaugcagaagcuc

SEQ ID NO: 68973 - RNA, 27 nt, Artificial Sequence
  FRAS1-related extracellular matrix protein 1 (98-106)
auccuggacgaggauaccgugaagcuc

SEQ ID NO: 68974 - RNA, 27 nt, Artificial Sequence
  HEAT repeat-containing protein 1 (1277-1285)
auccuggacgaggaaaaguucaacgug

SEQ ID NO: 68975 - RNA, 24 nt, Artificial Sequence
  Hemicentin-1 (2341-2348)
auccuggacgagggccacauucuc

SEQ ID NO: 68976 - RNA, 30 nt, Artificial Sequence
  Hemicentin-1 (2341-2350)
auccuggacgagggccacauucuccagcuu

SEQ ID NO: 68977 - RNA, 27 nt, Artificial Sequence
  Pleckstrin homology domain-containing family H member 1 (1314-1322)
auccuggaccacaacaccaugcaggug

SEQ ID NO: 68978 - RNA, 27 nt, Artificial Sequence
  Mitochondrial tRNA-specific 2-thiouridylase 1 (63-71)
auccuggacauucccuuccaccaggug

SEQ ID NO: 68979 - RNA, 27 nt, Artificial Sequence
  Protein GPR107 (122-130)
auccuggacauuagcagauccgaggug

SEQ ID NO: 68980 - RNA, 24 nt, Artificial Sequence
  Heat shock protein HSP 90-beta (496-503)
auccuggacaagaaaguggagaag

SEQ ID NO: 68981 - RNA, 27 nt, Artificial Sequence
  Anthrax toxin receptor 1 (48-56)
auccuggacaagagcggcuccgugcuc

SEQ ID NO: 68982 - RNA, 30 nt, Artificial Sequence
  UDP-glucose 4-epimerase (67-76)
auccuggaccagggcgcccuccaaagacuu

SEQ ID NO: 68983 - RNA, 33 nt, Artificial Sequence
  Pleckstrin homology-like domain family B member 1 (850-860)
auccuggacagccaggccggccaaauuagagcu

SEQ ID NO: 68984 - RNA, 27 nt, Artificial Sequence
  Chromobox protein homolog 6 (48-56)
auccuggacagcagacucauugccgcu

SEQ ID NO: 68985 - RNA, 30 nt, Artificial Sequence
  Voltage-dependent calcium channel subunit alpha-2/delta-2 (731-740)
auccuggacaccggcauuacacagcaacuc

SEQ ID NO: 68986 - RNA, 27 nt, Artificial Sequence
  Kinesin-like protein KIF1B (1497-1505)
auccuggacaccagcguggccuacguc

SEQ ID NO: 68987 - RNA, 27 nt, Artificial Sequence
  CAP-Gly domain-containing linker protein 4 (12-20)
auccuguucgaccccaagaccagcgug

SEQ ID NO: 68988 - RNA, 27 nt, Artificial Sequence
  ATP-binding cassette sub-family A member 13 (826-834)
auccuguucgagauuaaccccaagcuc

SEQ ID NO: 68989 - RNA, 27 nt, Artificial Sequence
  Carbonic anhydrase-related protein (233-241)
auccuguucagauacccccucaccauu

SEQ ID NO: 68990 - RNA, 27 nt, Artificial Sequence
  Tribbles homolog 1 (150-158)
auccugggcgagaccaaggccuacgug

SEQ ID NO: 68991 - RNA, 27 nt, Artificial Sequence
  KH domain-containing, RNA-binding, signal transduction-associated protein 1 (176-184)
auccugggcccccaggggaacaccauu

SEQ ID NO: 68992 - RNA, 24 nt, Artificial Sequence
  Epidermal growth factor receptor substrate 15 (164-171)
auccugggcagagugugggagcuc

SEQ ID NO: 68993 - RNA, 24 nt, Artificial Sequence
  Lecithin retinol acyltransferase (98-105)
auccugggcgugauugucaagguu

SEQ ID NO: 68994 - RNA, 111 nt, Artificial Sequence
  Glyceraldehyde-3-phosphate dehydrogenase (273-309)
auccugggcuacaccgagcaccagguggucagcuccgacuucaacucugauacacauucaaguacuuuugacgccggggcuggaauugcacucaaugaucacuucguuaag

SEQ ID NO: 68995 - RNA, 24 nt, Artificial Sequence
  Sperm-associated antigen 7 (80-87)
auccugcacgacguggucgagguu

SEQ ID NO: 68996 - RNA, 36 nt, Artificial Sequence
  Lysosomal-trafficking regulator (1804-1815)
auccugcacgagauuggcgggaccggaauauucgug

SEQ ID NO: 68997 - RNA, 27 nt, Artificial Sequence
  Coiled-coil domain-containing protein 93 (480-488)
auccugcacagaaagauugacgaggug

SEQ ID NO: 68998 - RNA, 27 nt, Artificial Sequence
  S1 RNA-binding domain-containing protein 1 (186-194)
auccugcacaccgacguggucuaccuc

SEQ ID NO: 68999 - RNA, 27 nt, Artificial Sequence
  Prolow-density lipoprotein receptor-related protein 1 (408-416)
auccugauugagcaccucuacggccuu

SEQ ID NO: 69000 - RNA, 27 nt, Artificial Sequence
  Tissue-type plasminogen activator (243-251)
auccugauuggcaagguguacaccgcc

SEQ ID NO: 69001 - RNA, 57 nt, Artificial Sequence
  ATP-citrate synthase (337-355)
auccugauuauaggcgggagcaucgccaacuucaccaauguggcugcaacauuuaag

SEQ ID NO: 69002 - RNA, 27 nt, Artificial Sequence
  Laminin subunit beta-1 (612-620)
auccugauuagauacgagccccagcuc

SEQ ID NO: 69003 - RNA, 27 nt, Artificial Sequence
  Receptor-interacting serine/threonine-protein kinase 4 (149-157)
auccugcucgacgcccacuaccaugug

SEQ ID NO: 69004 - RNA, 30 nt, Artificial Sequence
  CD109 antigen (864-873)
auccugcucgaccuuaccgauaacagacug

SEQ ID NO: 69005 - RNA, 27 nt, Artificial Sequence
  Lon protease homolog 2, peroxisomal (293-301)
auccugcucgacaacgaucacuacgcc

SEQ ID NO: 69006 - RNA, 27 nt, Artificial Sequence
  Zinc finger protein basonuclin-1 (109-117)
auccugcucgacagacuuuucagcgug

SEQ ID NO: 69007 - RNA, 27 nt, Artificial Sequence
  COP9 signalosome complex subunit 3 (213-221)
auccugcucggcaaggugcagcaacuu

SEQ ID NO: 69008 - RNA, 30 nt, Artificial Sequence
  T-lymphoma invasion and metastasis-inducing protein 1 (425-434)
auccugcucaccgccgcucagggcacagug

SEQ ID NO: 69009 - RNA, 27 nt, Artificial Sequence
  Transcription factor IIIB 90 kDa subunit (434-442)
auccugaacgagagcgaagccagagug

SEQ ID NO: 69010 - RNA, 30 nt, Artificial Sequence
  G-protein coupled receptor 143 (297-306)
auccugaaccccgcccagggcuuccuccuu

SEQ ID NO: 69011 - RNA, 27 nt, Artificial Sequence
  Adipocyte enhancer-binding protein 1 (945-953)
auccugaaccccggcgaguacagagug

SEQ ID NO: 69012 - RNA, 27 nt, Artificial Sequence
  Kinesin-like protein KIF13B (36-44)
auccugaaccccgugaauaccaaccuc

SEQ ID NO: 69013 - RNA, 27 nt, Artificial Sequence
  Lysine-specific demethylase 5B (178-186)
auccugaaccccuacaaucucuuccuu

SEQ ID NO: 69014 - RNA, 27 nt, Artificial Sequence
  Importin-7 (833-841)
auccugcccgccuucauucuccuuuuu

SEQ ID NO: 69015 - RNA, 33 nt, Artificial Sequence
  Lysosome-associated membraneoprotein 1 (248-258)
auccugcccgacgccagagauccugcuuucaag

SEQ ID NO: 69016 - RNA, 33 nt, Artificial Sequence; identical to SEQ ID NO: 44789
  Peroxisome biogenesis factor 1 (908-918)

SEQ ID NO: 69017 - RNA, 27 nt, Artificial Sequence
  E3 ubiquitin-protein ligase CBL-B (77-85)
auccugcccgacaccuaccagcaccuc

SEQ ID NO: 69018 - RNA, 27 nt, Artificial Sequence
  Estradiol 17-beta-dehydrogenase 11 (272-280)
auccugcccgagagauuccucgccgug

SEQ ID NO: 69019 - RNA, 27 nt, Artificial Sequence
  E1A-binding protein p400 (1032-1040)
auccugcccaagggcagcgccagagug

SEQ ID NO: 69020 - RNA, 27 nt, Artificial Sequence
  LINE-1 retrotransposable element ORF2 protein (817-825)
auccugcccaaggugauuuacagauuc

SEQ ID NO: 69021 - RNA, 27 nt, Artificial Sequence
  Aryl hydrocarbon receptor (23-31)
auccugcccccucagcucgcccuuuuc

SEQ ID NO: 69022 - RNA, 27 nt, Artificial Sequence
  Zinc finger and SCAN domain-containing protein 25 (93-101)
auccugcccagagaguucuacgccugg

SEQ ID NO: 69023 - RNA, 27 nt, Artificial Sequence
  DDB1- and CUL4-associated factor 4 (318-326)
auccugcaggacgagcaauaccucaug

SEQ ID NO: 69024 - RNA, 27 nt, Artificial Sequence
  Zinc finger protein RFP (330-338)
auccugagcgacaaccucagacaggug

SEQ ID NO: 69025 - RNA, 27 nt, Artificial Sequence
  AP2-associated protein kinase 1 (635-643)
auccugagcgacgugacccacuccgcc

SEQ ID NO: 69026 - RNA, 27 nt, Artificial Sequence
  Ras GTPase-activating protein 1 (674-682)
auccugagcgagcucguggaaaagauu

SEQ ID NO: 69027 - RNA, 27 nt, Artificial Sequence
  Mediator of RNA polymerase II transcription subunit 13 (1076-1084)
auccugagcgaguccgugaugaaccuc

SEQ ID NO: 69028 - RNA, 27 nt, Artificial Sequence
  Endoplasmic reticulum metallopeptidase 1 (340-348)
auccugaccgacagcauucagagagcc

SEQ ID NO: 69029 - RNA, 27 nt, Artificial Sequence
  Ankyrin repeat domain-containing protein 17 (886-894)
auccugaccgagacacagcaaggccuc

SEQ ID NO: 69030 - RNA, 27 nt, Artificial Sequence
  Notchless protein homolog 1 (240-248)
auccugaccggccacacacagagcgug

SEQ ID NO: 69031 - RNA, 24 nt, Artificial Sequence
  InaD-like protein (50-57)
auccugacccuccagcaaagcauu

SEQ ID NO: 69032 - RNA, 27 nt, Artificial Sequence
  Fibrous sheath-interacting protein 2 (3738-3746)
auccugaccaacaaucuccagcuuagc

SEQ ID NO: 69033 - RNA, 27 nt, Artificial Sequence
  Midasin (1057-1065)
auccugaccagcuccgugaagcucaac

SEQ ID NO: 69034 - RNA, 27 nt, Artificial Sequence
  Spatacsin (642-650)
auccugaccagcuacauuaacgagcuc

SEQ ID NO: 69035 - RNA, 27 nt, Artificial Sequence
  Eukaryotic translation initiation factor 2-alpha kinase 4 (377-385)
auccugguggagcacauuagcggcguc

SEQ ID NO: 69036 - RNA, 27 nt, Artificial Sequence
  Plexin-B2 (432-440)
auccugguggagauuaacaagagaguc

SEQ ID NO: 69037 - RNA, 27 nt, Artificial Sequence
  Heat shock factor protein 4 (167-175)
auccuguggagagagguggucacccuc

SEQ ID NO: 69038 - RNA, 27 nt, Artificial Sequence
  1-phosphatidylinositol 4,5-bisphosphate phosphodiesterase gamma-1 (109-117)
auccuguacggcauggaguucagacuc

SEQ ID NO: 69039 - RNA, 30 nt, Artificial Sequence; identical to SEQ ID NO: 44812
  116 kDa U5 small nuclear ribonucleoprotein component (202-211)

SEQ ID NO: 69040 - RNA, 27 nt, Artificial Sequence
  Eukaryotic translation initiation factor 4 gamma 3 (915-923)
aucaugcacgacugcguggucaagcug

SEQ ID NO: 69041 - RNA, 30 nt, Artificial Sequence
  Syntenin-1 (269-278)
aucaugcccgccuucauuuuugagcacaua

SEQ ID NO: 69042 - RNA, 27 nt, Artificial Sequence
  CLIP-associating protein 1 (410-418)
aucaugcccaccauuuucaaccugaua

SEQ ID NO: 69043 - RNA, 30 nt, Artificial Sequence
  Hexokinase-2 (118-127)
aucaugagaggcagcgggacccagcuguuc

SEQ ID NO: 69044 - RNA, 36 nt, Artificial Sequence
  Protein ERGIC-53 (496-507)
aucauguacagaagccagcaagaggccgcugcaaag

SEQ ID NO: 69045 - RNA, 66 nt, Artificial Sequence
  T-complex protein 1 subunit eta (413-434)
aucaacgcccugaccgcugcaagcgaggccgcgugccucauuguguccgucgacgaaacaauaaag

SEQ ID NO: 69046 - RNA, 36 nt, Artificial Sequence
  Vimentin (455-466)
aucaacgagaccagccagcaccaugacgaucuggaa

SEQ ID NO: 69047 - RNA, 24 nt, Artificial Sequence
  DNA-dependent protein kinase catalytic subunit (866-873)
aucaacaagaaucugcucaccgug

SEQ ID NO: 69048 - RNA, 21 nt, Artificial Sequence
  Deoxynucleotidyltransferase terminal-interacting protein 2 (255-261)
aucaacaagcccaauuucuac

SEQ ID NO: 69049 - RNA, 33 nt, Artificial Sequence
  Pleckstrin homology domain-containing family H member 1 (922-932)
aucaacgugcccgucgaggccgcuagcguugac

SEQ ID NO: 69050 - RNA, 24 nt, Artificial Sequence
  Sodium/potassium-transporting ATPase subunit alpha-1 (2-9)
auccccgccgaccugagaauuaua

SEQ ID NO: 69051 - RNA, 30 nt, Artificial Sequence
  Far upstream element-binding protein 1 (213-222)
auccccgccagcaaggcuggccuggugauu

SEQ ID NO: 69052 - RNA, 30 nt, Artificial Sequence
  Collagen alpha-1(XV) chain (185-194)
auccccuuccagagaagcucccaagcccug

SEQ ID NO: 69053 - RNA, 45 nt, Artificial Sequence
  Leucine-rich repeat-containing G-protein coupled receptor 6 (62-76)
auccccggccaggccuucagcgggcuguacucccucaagauucuu

SEQ ID NO: 69054 - RNA, 27 nt, Artificial Sequence
  Low-density lipoprotein receptor-related protein 2 (601-609)
aucccccacccuuucggcgugagccug

SEQ ID NO: 69055 - RNA, 24 nt, Artificial Sequence
  BCL-6 corepressor (730-737)
aucccccacaccccuauugagaua

SEQ ID NO: 69056 - RNA, 27 nt, Artificial Sequence
  Chondroitin sulfate proteoglycan 4 (108-116)
aucccccacaccgugguccugacaguu

SEQ ID NO: 69057 - RNA, 27 nt, Artificial Sequence
  C-syn protooncogene  (266-274)
auccccagagagagccugcagcucauu

SEQ ID NO: 69058 - RNA, 27 nt, Artificial Sequence
  Interferon-induced transmembrane protein 10 (62-70)
auccccagaccuccagccggcagcccg

SEQ ID NO: 69059 - RNA, 27 nt, Artificial Sequence
  Basement membrane-specific heparan sulfate proteoglycan core protein (447-455)
auccccagccacccuagagugaccguc

SEQ ID NO: 69060 - RNA, 45 nt, Artificial Sequence
  E3 ubiquitin-protein ligase RNF13 (145-159)
auccccagcguguucauuggcgaguccucugccaacucacugaag

SEQ ID NO: 69061 - RNA, 27 nt, Artificial Sequence
  Sorbin and SH3 domain-containing protein 2 (262-270)
auccccaccgccauuagaacaacugug

SEQ ID NO: 69062 - RNA, 27 nt, Artificial Sequence
  Procollagen-lysine,2-oxoglutarate 5-dioxygenase 2 (34-42)
auccccaccgacaagcugcucgugauu

SEQ ID NO: 69063 - RNA, 27 nt, Artificial Sequence
  Rap1 GTPase-activating protein 1 (28-36)
auccccuacccuagcgugcacgagguc

SEQ ID NO: 69064 - RNA, 27 nt, Artificial Sequence
  Spectrin beta chain, non-erythrocytic 1 (579-587)
auccaggccgagagagugaggggcguc

SEQ ID NO: 69065 - RNA, 24 nt, Artificial Sequence
  N6-adenosine-methyltransferase 70 kDa subunit (8-15)
auccaggcccacaagaaacaacug

SEQ ID NO: 69066 - RNA, 30 nt, Artificial Sequence
  Potassium/sodium hyperpolarization-activated cyclic nucleotide-gated channel 4 (778-787)
auccaggccccccugcaagcugcagccgcg

SEQ ID NO: 69067 - RNA, 27 nt, Artificial Sequence
  CCAAT/enhancer-binding protein zeta (255-263)
auccaggacgaugccgugcacacccug

SEQ ID NO: 69068 - RNA, 42 nt, Artificial Sequence
  Beta-2-microglobulin (21-34)
auccagagaacccccaagauucaaguguacagcaggcacccu

SEQ ID NO: 69069 - RNA, 45 nt, Artificial Sequence
  Beta-2-microglobulin (21-35)
auccagagaacccccaagauucaaguguacagcaggcacccugcc

SEQ ID NO: 69070 - RNA, 51 nt, Artificial Sequence
  Beta-2-microglobulin (21-37)
auccagagaacccccaagauucaaguguacagcaggcacccugccgagaac

SEQ ID NO: 69071 - RNA, 54 nt, Artificial Sequence
  Beta-2-microglobulin (21-38)
auccagagaacccccaagauucaaguguacagcaggcacccugccgagaacggc

SEQ ID NO: 69072 - RNA, 57 nt, Artificial Sequence
  Beta-2-microglobulin (21-39)
auccagagaacccccaagauucaaguguacagcaggcacccugccgagaacggcaaa

SEQ ID NO: 69073 - RNA, 60 nt, Artificial Sequence
  Beta-2-microglobulin (1-20)
auccagagaacccccaagauucaaguguacagcaggcacccugccgagaacggcaaaucc

SEQ ID NO: 69074 - RNA, 63 nt, Artificial Sequence
  Beta-2-microglobulin (1-21)
auccagagaacccccaagauucaaguguacagcaggcacccugccgagaacggcaaauccaau

SEQ ID NO: 69075 - RNA, 69 nt, Artificial Sequence
  Beta-2-microglobulin (21-43)
auccagagaacccccaagauucaaguguacagcaggcacccugccgagaacggcaaauccaauuuccug

SEQ ID NO: 69076 - RNA, 72 nt, Artificial Sequence
  Beta-2-microglobulin (21-44)
auccagagaacccccaagauucaaguguacagcaggcacccugccgagaacggcaaauccaauuuccugaac

SEQ ID NO: 69077 - RNA, 27 nt, Artificial Sequence
  Hemicentin-1 (876-884)
auccagagcgagaccacagugacuguc

SEQ ID NO: 69078 - RNA, 33 nt, Artificial Sequence
  Glia-derived nexin (392-402)
aucagacacaaccccaccggcgccgugcuguuc

SEQ ID NO: 69079 - RNA, 27 nt, Artificial Sequence
  Protein wntless homolog (302-310)
aucagacagggcauuuucuacgccaug

SEQ ID NO: 69080 - RNA, 21 nt, Artificial Sequence
  Synembryn-B (156-162)
aucagaagccagcugagguac

SEQ ID NO: 69081 - RNA, 27 nt, Artificial Sequence
  Clathrin heavy chain 1 (170-178)
aucagcgcccagcaaaacagagugguc

SEQ ID NO: 69082 - RNA, 24 nt, Artificial Sequence
  HLA class I histocompatibility antigen, B-44 alpha chain (218-225)
aucagcgaccacgaggugacccug

SEQ ID NO: 69083 - RNA, 27 nt, Artificial Sequence
  Integrin-alpha FG-GAP repeat-containing protein 2 (132-140)
aucagcgacauuggcgggcacgccuac

SEQ ID NO: 69084 - RNA, 24 nt, Artificial Sequence
  Protein arginine N-methyltransferase 1 (112-119)
aucagcgacuacgccgugaagauu

SEQ ID NO: 69085 - RNA, 27 nt, Artificial Sequence
  Membrane-associated transporter protein (237-245)
aucagcgaggccccccugaccgaagug

SEQ ID NO: 69086 - RNA, 24 nt, Artificial Sequence
  26S proteasome non-ATPase regulatory subunit 13 (64-71)
aucagcgaguucgaacacagagug

SEQ ID NO: 69087 - RNA, 21 nt, Artificial Sequence
  Cleft lip and palate transmembrane protein 1 (109-115)
aucagcgagcacgaacauuuc

SEQ ID NO: 69088 - RNA, 27 nt, Artificial Sequence
  Zinc finger protein ZFPM2 (861-869)
aucagcuucaacaagguggagaauuac

SEQ ID NO: 69089 - RNA, 30 nt, Artificial Sequence
  Neprilysin (536-545)
aucagcggcgccgcuguggucaacgcauuc

SEQ ID NO: 69090 - RNA, 33 nt, Artificial Sequence
  Annexin A2 (214-224)
aucagcauuaugaccgagagauccgugccccac

SEQ ID NO: 69091 - RNA, 27 nt, Artificial Sequence
  Integrin alpha-6 (516-524)
aucagcauugugggcacccuggaggcc

SEQ ID NO: 69092 - RNA, 27 nt, Artificial Sequence
  Transcription factor SOX-10 (334-342)
aucagcaagcccccuggcguggcccug

SEQ ID NO: 69093 - RNA, 24 nt, Artificial Sequence
  Serine-protein kinase ATM (1999-2006)
aucagccugcaggaccuccuucug

SEQ ID NO: 69094 - RNA, 45 nt, Artificial Sequence
  Glia-derived nexin (263-277)
aucagcaugcugauugcccuccccaccgaguccucuacaccucuu

SEQ ID NO: 69095 - RNA, 27 nt, Artificial Sequence
  Unconventional myosin-XVIIIa (62-70)
aucagcaaccccauuccuauaaaggug

SEQ ID NO: 69096 - RNA, 27 nt, Artificial Sequence
  Interferon regulatory factor 3 (68-76)
aucagcaacucccacccccugucucuc

SEQ ID NO: 69097 - RNA, 27 nt, Artificial Sequence
  Poly (ADP-ribose) polymerase 14 (310-318)
aucagccccggcagauacuuccugcuc

SEQ ID NO: 69098 - RNA, 48 nt, Artificial Sequence
  Disintegrin and metalloproteinase domain-containing protein 10 (189-204)
aucagcucccacgugaaggccauugacaccauauaccagacaacugau

SEQ ID NO: 69099 - RNA, 30 nt, Artificial Sequence
  Dolichyl-diphosphooligosaccharide-proteinosyltransferase subunit 2 (230-239)
aucagcaccgaggugggcauuacaaacguc

SEQ ID NO: 69100 - RNA, 27 nt, Artificial Sequence
  Peroxisome biogenesis factor 1 (593-601)
aucagcaccagagagaagcuggugcuc

SEQ ID NO: 69101 - RNA, 27 nt, Artificial Sequence
  Hemicentin-1 (2-10)
aucagcugggaggugguccacaccguu

SEQ ID NO: 69102 - RNA, 27 nt, Artificial Sequence
  UDP-N-acetylhexosamine pyrophosphorylase (463-471)
aucaccgccgacgugaaccacaaucug

SEQ ID NO: 69103 - RNA, 33 nt, Artificial Sequence
  Endoplasmin (418-428)
aucaccgacgauuuccacgacaugaugcccaag

SEQ ID NO: 69104 - RNA, 27 nt, Artificial Sequence
  Maltase-glucoamylase (141-149)
aucaccgacuucaacaauauuagauac

SEQ ID NO: 69105 - RNA, 21 nt, Artificial Sequence
  Hemicentin-1 (2935-2941)
aucaccgacauuggcagauac

SEQ ID NO: 69106 - RNA, 24 nt, Artificial Sequence
  Ral GTPase-activating protein subunit beta (1463-1470)
aucaccgacauugugaacaaguac

SEQ ID NO: 69107 - RNA, 24 nt, Artificial Sequence
  Myosin-9 (315-322)
aucaccgaccuggaggaaagacuc

SEQ ID NO: 69108 - RNA, 27 nt, Artificial Sequence
  Protein piccolo (883-891)
aucaccgaccugcagaaggaguucuac

SEQ ID NO: 69109 - RNA, 30 nt, Artificial Sequence
  Titin (15513-15522)
aucaccggccugacagagaaccaggaauac

SEQ ID NO: 69110 - RNA, 27 nt, Artificial Sequence
  Leucine-rich repeat-containing protein 34 (306-314)
aucacccacgacggcaugguguaccug

SEQ ID NO: 69111 - RNA, 24 nt, Artificial Sequence
  Titin (14574-14581)
aucaccaaggacagcgugacacug

SEQ ID NO: 69112 - RNA, 21 nt, Artificial Sequence
  Elongation factor 2 (165-171)
aucaccaagggcgugcaguac

SEQ ID NO: 69113 - RNA, 27 nt, Artificial Sequence
  CLIP-associating protein 1 (390-398)
aucacccugggccaccucagcuccgug

SEQ ID NO: 69114 - RNA, 27 nt, Artificial Sequence
  Armadillo repeat-containing X-linked protein 2 (498-506)
aucaccaacgacuaccagcaccugcuc

SEQ ID NO: 69115 - RNA, 30 nt, Artificial Sequence
  Titin (16885-16894)
aucaccaaccugacacagggcgaggaauac

SEQ ID NO: 69116 - RNA, 27 nt, Artificial Sequence
  Heat shock 70 kDa protein 1-like (299-307)
aucaccagagccagguucgaggaacug

SEQ ID NO: 69117 - RNA, 60 nt, Artificial Sequence
  L-lactate dehydrogenase A chain (23-42)
aucaccguggucggcguuggggccgugggaauggcuugcgcaauuagcauacugaugaag

SEQ ID NO: 69118 - RNA, 60 nt, Artificial Sequence
  L-lactate dehydrogenase B chain (24-43)
aucaccguggucggcguugggcaggugggaauggccugcgcuauuagcauacuggguaag

SEQ ID NO: 69119 - RNA, 27 nt, Artificial Sequence
  G protein-coupled receptor kinase 4 (6-14)
aucguggccaacagccugcuccuuaag

SEQ ID NO: 69120 - RNA, 27 nt, Artificial Sequence
  G protein-coupled receptor kinase 6 (6-14)
aucguggccaacaccguccugcucaag

SEQ ID NO: 69121 - RNA, 27 nt, Artificial Sequence
  T-cell surfaceoprotein CD8 beta chain (211-219)
aucgugugccugaagauuagcggcuuc

SEQ ID NO: 69122 - RNA, 27 nt, Artificial Sequence
  Sorting nexin-13 (161-169)
aucguggacgauuucggcacccaccug

SEQ ID NO: 69123 - RNA, 27 nt, Artificial Sequence
  Tripartite motif-containing protein 2 (200-208)
aucguggacgauauucacagcaccuuc

SEQ ID NO: 69124 - RNA, 27 nt, Artificial Sequence
  Fibronectin isoform 7 (519-527)
aucguggacgauauuaccuacaacguc

SEQ ID NO: 69125 - RNA, 27 nt, Artificial Sequence
  U3 small nucleolar ribonucleoprotein protein MPP10 (190-198)
aucguggacgauaaguucuuuaaacug

SEQ ID NO: 69126 - RNA, 24 nt, Artificial Sequence
  Alpha-actinin-1 (115-122)
aucguggacggcaacgucaagaug

SEQ ID NO: 69127 - RNA, 30 nt, Artificial Sequence
  Methylcrotonoyl-CoA carboxylase beta chain, mitochondrial (300-309)
aucguggacggcagcagauucaccgaguuu

SEQ ID NO: 69128 - RNA, 27 nt, Artificial Sequence
  Proteasome inhibitor PI31 subunit (209-217)
aucguggacccccugagaagcggcuuc

SEQ ID NO: 69129 - RNA, 27 nt, Artificial Sequence
  Neutral amino acid transporter A (156-164)
aucguggacagaaccacaacugucguu

SEQ ID NO: 69130 - RNA, 27 nt, Artificial Sequence
  HMG domain-containing protein 3 (1356-1364)
aucguggacagcaagcccaacggcguc

SEQ ID NO: 69131 - RNA, 27 nt, Artificial Sequence
  Synemin (748-756)
aucguggaggaacccgucagcuacguu

SEQ ID NO: 69132 - RNA, 33 nt, Artificial Sequence
  Glia-derived nexin (63-73)
aucgugauuagcccccacggcauagccuccguc

SEQ ID NO: 69133 - RNA, 36 nt, Artificial Sequence
  Sterol regulatory element-binding protein 2 (1129-1140)
aucgugaagcugggcgggggaaccgccauugcugca

SEQ ID NO: 69134 - RNA, 51 nt, Artificial Sequence
  Melanoma-associated antigen 4 (205-221)
aucgugcugggcaccauugccauggagggggacagcgcuuccgaagaggaa

SEQ ID NO: 69135 - RNA, 27 nt, Artificial Sequence
  Elongator complex protein 4 (107-115)
aucgugaacggccacacccugcucguc

SEQ ID NO: 69136 - RNA, 30 nt, Artificial Sequence
  Rho guanine nucleotide exchange factor 2 (500-509)
aucgugagagacauugccaaccaggagaag

SEQ ID NO: 69137 - RNA, 27 nt, Artificial Sequence
  Cytoplasmic dynein 1 heavy chain 1 (1043-1051)
aucgugagcgaggucgaacaguacguu

SEQ ID NO: 69138 - RNA, 42 nt, Artificial Sequence
  Glia-derived nexin (119-132)
aucgugaccgucgccaacgcuguuuucgugaagaaugcaagc

SEQ ID NO: 69139 - RNA, 30 nt, Artificial Sequence
  Neuropilin-2 (58-67)
aucguguacgcccccgagccuaaccagaag

SEQ ID NO: 69140 - RNA, 27 nt, Artificial Sequence
  Mitochondrial calcium uniporter regulator 1 (3-11)
aucguguacaaggacauggucaccaaa

SEQ ID NO: 69141 - RNA, 27 nt, Artificial Sequence
  Transmembrane emp24 domain-containing protein 5 (5-13)
aucuggcugcccuucccugugcuccuu

SEQ ID NO: 69142 - RNA, 27 nt, Artificial Sequence
  Unconventional myosin-Va (407-415)
aucuacgccaagcuguucaacuggauu

SEQ ID NO: 69143 - RNA, 27 nt, Artificial Sequence
  Alpha-soluble NSF attachment protein (44-52)
aucuacgccagagcugcaaacauguuc

SEQ ID NO: 69144 - RNA, 27 nt, Artificial Sequence
  DNA polymerase delta subunit 2 (88-96)
aucuacgccaccagacugauucagaug

SEQ ID NO: 69145 - RNA, 24 nt, Artificial Sequence
  39S ribosomal protein L20, mitochondrial (107-114)
aucuacgagcccaagaccuucaaa

SEQ ID NO: 69146 - RNA, 27 nt, Artificial Sequence
  V-type proton ATPase 116 kDa subunit a isoform 1 (560-568)
aucuacuucaagaaaccccugaacauu

SEQ ID NO: 69147 - RNA, 33 nt, Artificial Sequence
  Antizyme inhibitor 1 (258-268)
aucuacuuccccgagggcagcggggugaagauu

SEQ ID NO: 69148 - RNA, 30 nt, Artificial Sequence
  Protein disulfide-isomerase A3 (453-462)
aucuacuucagccccgccaacaagaaacug

SEQ ID NO: 69149 - RNA, 24 nt, Artificial Sequence
  Zinc finger protein 382 (116-123)
aucuacggcaagaccuucacacug

SEQ ID NO: 69150 - RNA, 27 nt, Artificial Sequence
  Protein kinase C and casein kinase substrate in neurons protein 2 (266-274)
aucuaccacgaccuggagcagagcauu

SEQ ID NO: 69151 - RNA, 27 nt, Artificial Sequence
  Ubiquitin-conjugating enzyme E2 N (75-83)
aucuaccaccccaacguggacaagcug

SEQ ID NO: 69152 - RNA, 27 nt, Artificial Sequence
  Diacylglycerol kinase zeta (748-756)
aucuacauucuggaccccgagcuccuu

SEQ ID NO: 69153 - RNA, 27 nt, Artificial Sequence
  Lysosomal protective protein (183-191)
aucuacauucccacccuggccgugcuc

SEQ ID NO: 69154 - RNA, 27 nt, Artificial Sequence
  Protein unc-119 homolog A (83-91)
aucuacaagauugacuucgugagauuu

SEQ ID NO: 69155 - RNA, 30 nt, Artificial Sequence
  Alpha-2-macroglobulin (162-171)
aucuacaagcccggccagaccgugaaauuc

SEQ ID NO: 69156 - RNA, 27 nt, Artificial Sequence
  Tubby-related protein 4 (640-648)
aucuaccugcccgaggugagaaagauu

SEQ ID NO: 69157 - RNA, 27 nt, Artificial Sequence
  Alpha-adducin (165-173)
aucuacaaccacauuaccacaagagug

SEQ ID NO: 69158 - RNA, 27 nt, Artificial Sequence
  Sprouty-related, EVH1 domain-containing protein 1 (81-89)
aucuacaacaaggugacccccacauuc

SEQ ID NO: 69159 - RNA, 27 nt, Artificial Sequence
  Serine-protein kinase ATM (1147-1155)
aucuacaacagaaagagcgugcugcuc

SEQ ID NO: 69160 - RNA, 27 nt, Artificial Sequence
  Spermine synthase (46-54)
aucuacccccacggccuggugcuccuu

SEQ ID NO: 69161 - RNA, 27 nt, Artificial Sequence
  E3 ubiquitin-protein ligase RNF213 (3834-3842)
aucuacccccaggugcugcacagccuc

SEQ ID NO: 69162 - RNA, 30 nt, Artificial Sequence; identical to SEQ ID NO: 44935
  Nuclear fragile X mental retardation-interacting protein 2 (473-482)

SEQ ID NO: 69163 - RNA, 27 nt, Artificial Sequence
  Zinc finger protein castor homolog 1 (463-471)
aucuaccagaaguauauugccagauuc

SEQ ID NO: 69164 - RNA, 27 nt, Artificial Sequence
  Renin receptor (327-335)
aucuacagaaugaccaaccagaagauu

SEQ ID NO: 69165 - RNA, 27 nt, Artificial Sequence
  Pericentriolar material 1 protein (1385-1393)
aucuacagcgagguggccacccugauu

SEQ ID NO: 69166 - RNA, 33 nt, Artificial Sequence
  Perilipin-2 (353-363)
aucuacagcguguucagaaacgccgcuuccuuu

SEQ ID NO: 69167 - RNA, 27 nt, Artificial Sequence
  Poly (ADP-ribose) polymerase 14 (1584-1592)
aucuacacccacggcaaccauagccug

SEQ ID NO: 69168 - RNA, 27 nt, Artificial Sequence
  Transmembraneoprotein NMB (174-182)
aucuacguguuccacacccugggcugg

SEQ ID NO: 69169 - RNA, 27 nt, Artificial Sequence
  Protein-methionine sulfoxide oxidase MICAL3 (1990-1998)
aucuacgugccccacgcccuggcuuuc

SEQ ID NO: 69170 - RNA, 27 nt, Artificial Sequence
  Clathrin heavy chain 1 (1130-1138)
aaggccgacgaucccagcuccuacaug

SEQ ID NO: 69171 - RNA, 33 nt, Artificial Sequence
  L-dopachrome tautomerase (356-366)
aaggccgacggcacccuggauagccaggugaug

SEQ ID NO: 69172 - RNA, 27 nt, Artificial Sequence
  Activating signal cointegrator 1 complex subunit 2 (32-40)
aaggccgacagauacuucgugcuguau

SEQ ID NO: 69173 - RNA, 27 nt, Artificial Sequence
  Lupus La protein (148-156)
aaggccuucaaaggcagcaucuuugug

SEQ ID NO: 69174 - RNA, 27 nt, Artificial Sequence
  Neuronal PAS domain-containing protein 3 (509-517)
aaggccggcgaggacggguucggagcu

SEQ ID NO: 69175 - RNA, 27 nt, Artificial Sequence
  Filamin-A (2252-2260)
aaggccggcaacaauaugcugcucgug

SEQ ID NO: 69176 - RNA, 27 nt, Artificial Sequence
  Alpha-soluble NSF attachment protein (180-188)
aaggccaucgacauuuacgagcaggug

SEQ ID NO: 69177 - RNA, 27 nt, Artificial Sequence
  Phosphorylase b kinase regulatory subunit beta (81-89)
aaggccaaaauccaggacagccuguac

SEQ ID NO: 69178 - RNA, 33 nt, Artificial Sequence
  Vacuolar protein sorting-associated protein 13A (1058-1068)
aaggcccuggugggcggggcugucggaggucuc

SEQ ID NO: 69179 - RNA, 33 nt, Artificial Sequence
  Zinc finger homeobox protein 3 (2172-2182)
aaggccaacgaggugcugggccucgcugcacag

SEQ ID NO: 69180 - RNA, 54 nt, Artificial Sequence
  Bifunctional glutamate/proline-tRNA ligase (778-795)
aaggcccccaaagaggacguggaugcugcagucaagcagcugcucagccuuaaa

SEQ ID NO: 69181 - RNA, 27 nt, Artificial Sequence
  Treacle protein (215-223)
aaggccagcgagaaaauccugcaggug

SEQ ID NO: 69182 - RNA, 30 nt, Artificial Sequence
  Cytoplasmic dynein 1 heavy chain 1 (1729-1738)
aaggccaccagcaucgaccccaacacauac

SEQ ID NO: 69183 - RNA, 27 nt, Artificial Sequence
  Tubulin alpha-1A chain (171-179)
aaggccuaccacgagcagcugagcgug

SEQ ID NO: 69184 - RNA, 30 nt, Artificial Sequence
  UDP-N-acetylhexosamine pyrophosphorylase-like protein 1 (151-160)
aaggccuaccccgaggaaccugugggcguc

SEQ ID NO: 69185 - RNA, 75 nt, Artificial Sequence
  Beta-2-microglobulin (74-98)
aaggacgaguacgccugcagagugaaccacgucacccugagccagcccaaaaucguuaagugggauagggacaug

SEQ ID NO: 69186 - RNA, 45 nt, Artificial Sequence
  Glia-derived nexin (117-131)
aaggacaucgugaccgucgccaacgcuguuuucgugaaaaaugca

SEQ ID NO: 69187 - RNA, 48 nt, Artificial Sequence
  Glia-derived nexin (117-132)
aaggacaucgugaccgucgccaacgcuguuuucgugaaaaaugcaagc

SEQ ID NO: 69188 - RNA, 27 nt, Artificial Sequence
  Serine-protein kinase ATM (129-137)
aaggacagcuccaacggcgccaucuac

SEQ ID NO: 69189 - RNA, 27 nt, Artificial Sequence
  E3 ubiquitin-protein ligase RNF213 (4774-4782)
aaggaggccgaacugagacucgugaaa

SEQ ID NO: 69190 - RNA, 27 nt, Artificial Sequence
  Neuron navigator 2 (1035-1043)
aaggaggacagcagaccccaccuguuc

SEQ ID NO: 69191 - RNA, 30 nt, Artificial Sequence
  Multidrug resistance-associated protein 7 (836-845)
aaggagggcgccguggcucugcacgucuac

SEQ ID NO: 69192 - RNA, 30 nt, Artificial Sequence
  Hemicentin-1 (4939-4948)
aaggagaucggcgaagccgugaacggguuc

SEQ ID NO: 69193 - RNA, 27 nt, Artificial Sequence
  Synemin (925-933)
aaggagaucaaaauuccccacgaauuc

SEQ ID NO: 69194 - RNA, 30 nt, Artificial Sequence
  Annexin A1 (147-156)
aaggagaucagagacauuaacaggguguac

SEQ ID NO: 69195 - RNA, 27 nt, Artificial Sequence
  Probable global transcription activator SNF2L1 (774-782)
aaggagaaacugcucacccagggcuuc

SEQ ID NO: 69196 - RNA, 57 nt, Artificial Sequence
  Protein FAM208B (1764-1782)
aaggagaaccugagcaaagaaccccucgccuccuucgugucugagucauuugacacc

SEQ ID NO: 69197 - RNA, 27 nt, Artificial Sequence
  Cullin-4B (885-893)
aaggagaaccccaaucaguacaacuau

SEQ ID NO: 69198 - RNA, 69 nt, Artificial Sequence
  60S ribosomal protein L18 (16-38)
aaggagcccaaaagccaggacaucuaccugagacuccuugugaagcuguauagguucuuggcccggcgc

SEQ ID NO: 69199 - RNA, 30 nt, Artificial Sequence; identical to SEQ ID NO: 44972
  Melanoma-associated antigen 10 (192-201)

SEQ ID NO: 69200 - RNA, 30 nt, Artificial Sequence; identical to SEQ ID NO: 44973
  Melanoma-associated antigen 11 (251-260)

SEQ ID NO: 69201 - RNA, 30 nt, Artificial Sequence
  Melanoma-associated antigen 4 (168-177)
aaggagguggaccccaccagcaacacauac

SEQ ID NO: 69202 - RNA, 57 nt, Artificial Sequence
  ATP-dependent RNA helicase A (392-410)
aaguucgagagcgaaauccuggaggccauuucccagaacucuguggucauaaucaga

SEQ ID NO: 69203 - RNA, 30 nt, Artificial Sequence
  ATP synthase-coupling factor 6, mitochondrial (99-108)
aaguucgaggugaucgaaaaaccccaggcc

SEQ ID NO: 69204 - RNA, 42 nt, Artificial Sequence
  B-cell CLL/lymphoma 9 protein (45-58)
aaguucagcaaccagggcaaacaagggggauccgccucucag

SEQ ID NO: 69205 - RNA, 27 nt, Artificial Sequence
  Collagen alpha-1(IV) chain (238-246)
aaguucagcaccaugcccuuucuguuc

SEQ ID NO: 69206 - RNA, 27 nt, Artificial Sequence
  Protein diaphanous homolog 2 (949-957)
aaguucguggagaaaaugaccagcuuu

SEQ ID NO: 69207 - RNA, 30 nt, Artificial Sequence
  V-type proton ATPase 116 kDa subunit a isoform 1 (813-822)
aaguucuacagcggcaccggguuuaaauuc

SEQ ID NO: 69208 - RNA, 60 nt, Artificial Sequence
  Collagen alpha-2(I) chain (441-460)
aagggcgagcccgggguggucggagccguugguaccgcuggcccuagcgggccauccgga

SEQ ID NO: 69209 - RNA, 48 nt, Artificial Sequence
  Calpain small subunit 1 (9-24)
aagggcgggggagguggcgggggaggcggugggggacugggcggcggg

SEQ ID NO: 69210 - RNA, 78 nt, Artificial Sequence
  HLA class I histocompatibility antigen, A-23 alpha chain (340-365)
aagggcgggagcuacucccaggccgcuucuucagacagugcacaaggaagcgaugugucccugaccgccugcaaaguc

SEQ ID NO: 69211 - RNA, 78 nt, Artificial Sequence
  HLA class I histocompatibility antigen, A-1 alpha chain (315-340)
aagggcgggagcuacacccaggccgcuuccucugacucagcacaaggaagugaugugagccugacagccugcaaaguc

SEQ ID NO: 69212 - RNA, 114 nt, Artificial Sequence
  Cytochrome c oxidase subunit 7A2, mitochondrial (46-83)
aagggcgggguggccgacgcucugcucuacagagcaaccaugauccuuacagucggagguacugccuaugcgauuuacgagcuggcuguugccagcuuccccaaaaagcaggaa

SEQ ID NO: 69213 - RNA, 30 nt, Artificial Sequence
  Nebulin (852-861)
aagggcaaaaugaucggggcccugagcauu

SEQ ID NO: 69214 - RNA, 30 nt, Artificial Sequence
  Fatty acid synthase (2391-2400)
aagggccuggaggaaagaguggccgcugca

SEQ ID NO: 69215 - RNA, 27 nt, Artificial Sequence
  E3 ubiquitin-protein ligase HUWE1 (1718-1726)
aagggcaacgacaccccccuggcccuc

SEQ ID NO: 69216 - RNA, 27 nt, Artificial Sequence
  Vigilin (314-322)
aagggcaacagccugcaggagauccuc

SEQ ID NO: 69217 - RNA, 24 nt, Artificial Sequence
  UDP-glucose:glycoprotein glucosyltransferase 1 (1055-1062)
aagggccccaucgccaaauuccug

SEQ ID NO: 69218 - RNA, 27 nt, Artificial Sequence
  Serine/arginine-rich splicing factor 4 (23-31)
aagggcuacgggaaaauccuggaggug

SEQ ID NO: 69219 - RNA, 75 nt, Artificial Sequence
  Histidine triad nucleotide-binding protein 1 (58-82)
aagcacaucagccagauuuccguggccgaggacgaugacgaaucucugcucggccaucuuaugauagucgggaaa

SEQ ID NO: 69220 - RNA, 24 nt, Artificial Sequence
  Trabeculin-alpha (4579-4586)
aagcacaaagaguuccagaagacc

SEQ ID NO: 69221 - RNA, 27 nt, Artificial Sequence
  Unconventional myosin-VIIa (1948-1956)
aagaucgccgacaaagugcugagcguc

SEQ ID NO: 69222 - RNA, 21 nt, Artificial Sequence
  LIM domain transcription factor LMO4 (29-35)
aagaucgccgacagauuccug

SEQ ID NO: 69223 - RNA, 30 nt, Artificial Sequence
  MICOS complex subunit MIC60 (45-54)
aagaucgccggcgcugggcugcucuucgug

SEQ ID NO: 69224 - RNA, 36 nt, Artificial Sequence
  Calcium-binding mitochondrial carrier protein SCaMC-2 (252-263)
aagaucgcccccgagagcgcuauuaaauucauggca

SEQ ID NO: 69225 - RNA, 27 nt, Artificial Sequence
  Protein TASOR (673-681)
aagaucgccagcaacccccuggagaga

SEQ ID NO: 69226 - RNA, 27 nt, Artificial Sequence
  UV excision repair protein RAD23 homolog B (42-50)
aagaucgacgagaaaaacuucgugguc

SEQ ID NO: 69227 - RNA, 27 nt, Artificial Sequence
  RNA-binding protein 5 (302-310)
aagaucgacggcaaaaccauuggggug

SEQ ID NO: 69228 - RNA, 27 nt, Artificial Sequence
  26S protease regulatory subunit 7 (156-164)
aagaucgaccccaccgugacaaugaug

SEQ ID NO: 69229 - RNA, 33 nt, Artificial Sequence
  26S protease regulatory subunit 7 (156-166)
aagaucgaccccaccgugacaaugaugcagguc

SEQ ID NO: 69230 - RNA, 27 nt, Artificial Sequence
  Thioredoxin reductase 1, cytoplasmic (299-307)
aagaucggccuggagaccguggggguc

SEQ ID NO: 69231 - RNA, 30 nt, Artificial Sequence
  1-phosphatidylinositol 4,5-bisphosphate phosphodiesterase gamma-1 (969-978)
aagaucggcaccgagagagccugcuacagg

SEQ ID NO: 69232 - RNA, 24 nt, Artificial Sequence
  Heat shock protein 105 kDa (711-718)
aagaucggcacccccgugaaaguc

SEQ ID NO: 69233 - RNA, 30 nt, Artificial Sequence
  Pleckstrin homology domain-containing family G member 3 (122-131)
aagaucauugacacccccggccugcucaaa

SEQ ID NO: 69234 - RNA, 27 nt, Artificial Sequence
  Unconventional myosin-Id (269-277)
aagauccuggccgcuauucuccaccuu

SEQ ID NO: 69235 - RNA, 30 nt, Artificial Sequence; identical to SEQ ID NO: 45008
  Kinesin-like protein KIF1B (1496-1505)

SEQ ID NO: 69236 - RNA, 27 nt, Artificial Sequence
  28S ribosomal protein S2, mitochondrial (61-69)
aagauccugaacgagccccucaaacac

SEQ ID NO: 69237 - RNA, 33 nt, Artificial Sequence
  D-3-phosphoglycerate dehydrogenase (21-31)
aagauccugcaggacggcgggcuccaagugguc

SEQ ID NO: 69238 - RNA, 27 nt, Artificial Sequence
  Endothelial differentiation-related factor 1 (98-106)
aagaucaacgagaaaccccaggugauu

SEQ ID NO: 69239 - RNA, 27 nt, Artificial Sequence
  Upstream stimulatory factor 2 (138-146)
aagaucaacaauuggauugugcagcug

SEQ ID NO: 69240 - RNA, 27 nt, Artificial Sequence
  Sodium/potassium/calcium exchanger 5 (219-227)
aagaucaaccaguacauuauaaaaaag

SEQ ID NO: 69241 - RNA, 27 nt, Artificial Sequence
  Protein sidekick-1 (309-317)
aagauccagggccugagcucccucacc

SEQ ID NO: 69242 - RNA, 27 nt, Artificial Sequence
  Keratinocyte-associated protein 2 (136-144)
aagaucagcuccacccuguaccaggcc

SEQ ID NO: 69243 - RNA, 33 nt, Artificial Sequence
  Dolichyl-diphosphooligosaccharide-proteinosyltransferase subunit 2 (368-378)
aagaucagcaccgaggugggcauuacaaacguc

SEQ ID NO: 69244 - RNA, 33 nt, Artificial Sequence
  Melanoma-associated antigen 6 (220-230)
aagaucugggaggaacugagcgugcucgagguc

SEQ ID NO: 69245 - RNA, 33 nt, Artificial Sequence
  Ras GTPase-activating-like protein IQGAP1 (94-104)
aagaucuacgacagagagcagaccagguauaaa

SEQ ID NO: 69246 - RNA, 27 nt, Artificial Sequence
  NADH dehydrogenase (ubiquinone) 1 beta subcomplex subunit 5, mitochondrial (79-87)
aagaucuacgagagaaccauggccgug

SEQ ID NO: 69247 - RNA, 24 nt, Artificial Sequence
  Lariat debranching enzyme (72-79)
aagaaagcccccgugcugacccuc

SEQ ID NO: 69248 - RNA, 24 nt, Artificial Sequence
  Myc proto-oncogene protein (412-419)
aagaaagccaccgcuuacauccug

SEQ ID NO: 69249 - RNA, 27 nt, Artificial Sequence
  Zinc phosphodiesterase ELAC protein 2 (366-374)
aagaaagagggccccacccugagcgug

SEQ ID NO: 69250 - RNA, 48 nt, Artificial Sequence
  Serum albumin (437-452)
aagaaagugccccaggucagcaccccuacacugguugagguguccaga

SEQ ID NO: 69251 - RNA, 27 nt, Artificial Sequence
  Nuclear mitotic apparatus protein 1 (1-9)
aagcuggccgacgaucucagcacccuu

SEQ ID NO: 69252 - RNA, 27 nt, Artificial Sequence
  SNW domain-containing protein 1 (28-36)
aagcuggccgaggcucucuacaucgca

SEQ ID NO: 69253 - RNA, 27 nt, Artificial Sequence
  Vesicle transport protein USE1 (171-179)
aagcuggccgaggaaaugcucggccuu

SEQ ID NO: 69254 - RNA, 27 nt, Artificial Sequence
  SLIT-ROBO Rho GTPase-activating protein 2C (69-77)
aagcuggccgagcacuuccucgcuaaa

SEQ ID NO: 69255 - RNA, 27 nt, Artificial Sequence
  Plexin-A3 (55-63)
aagcuggcccccaaccucaccgagcuu

SEQ ID NO: 69256 - RNA, 27 nt, Artificial Sequence
  Peroxisome biogenesis factor 1 (411-419)
aagcuggacgcccacguggagagaguc

SEQ ID NO: 69257 - RNA, 27 nt, Artificial Sequence
  Probable helicase with zinc finger domain (944-952)
aagcuggacgauggcagcaucggggug

SEQ ID NO: 69258 - RNA, 27 nt, Artificial Sequence
  Afadin (391-399)
aagcuggacgauaacagcauccagcuc

SEQ ID NO: 69259 - RNA, 27 nt, Artificial Sequence
  E3 ubiquitin-protein ligase RNF139 (456-464)
aagcuggacgauuacguguauuacguc

SEQ ID NO: 69260 - RNA, 27 nt, Artificial Sequence
  Transcriptional regulator ATRX (1499-1507)
aagcuggacuucagcaccgcccucgug

SEQ ID NO: 69261 - RNA, 27 nt, Artificial Sequence
  Probable ATP-dependent RNA helicase DHX58 (177-185)
aagcuggacggcgccaucaaccacgug

SEQ ID NO: 69262 - RNA, 27 nt, Artificial Sequence
  Serine/threonine-protein kinase Sgk3 (115-123)
aagcuggacggcaaauucuacgccgug

SEQ ID NO: 69263 - RNA, 27 nt, Artificial Sequence
  Inter-alpha-trypsin inhibitor heavy chain H5 (522-530)
aagcuggaccaccuccauguggagguc

SEQ ID NO: 69264 - RNA, 27 nt, Artificial Sequence
  Kin of IRRE-like protein 1 (435-443)
aagcuggacaucaaaguggagaccguc

SEQ ID NO: 69265 - RNA, 27 nt, Artificial Sequence
  Tectonic-1 (198-206)
aagcuggacauccccaccgccgcuaaa

SEQ ID NO: 69266 - RNA, 30 nt, Artificial Sequence; identical to SEQ ID NO: 45039
  Lactoperoxidase (313-322)

SEQ ID NO: 69267 - RNA, 27 nt, Artificial Sequence
  WD repeat-containing protein 26 (306-314)
aagcuggacaacaaucucgauagcgug

SEQ ID NO: 69268 - RNA, 27 nt, Artificial Sequence
  Cytoplasmic dynein 1 heavy chain 1 (828-836)
aagcuggaccccuacgugcagagacuc

SEQ ID NO: 69269 - RNA, 27 nt, Artificial Sequence
  cAMP-dependent protein kinase type I-beta regulatory subunit (349-357)
aagcuggacagacccagguucgagcgg

SEQ ID NO: 69270 - RNA, 33 nt, Artificial Sequence; identical to SEQ ID NO: 45043
  SH3 domain-binding protein 4 (249-259)

SEQ ID NO: 69271 - RNA, 27 nt, Artificial Sequence
  Eukaryotic initiation factor 4A-II (260-268)
aagcuggacacccucugcgaucuuuac

SEQ ID NO: 69272 - RNA, 30 nt, Artificial Sequence
  Eukaryotic translation initiation factor 3 subunit I (213-222)
aagcuguucgacagcaccacacucgagcac

SEQ ID NO: 69273 - RNA, 27 nt, Artificial Sequence
  Centromere protein R (110-118)
aagcuguucgagaaaagcaccggccuc

SEQ ID NO: 69274 - RNA, 27 nt, Artificial Sequence
  Protein kinase C delta type (581-589)
aagcuguucgagagagaacccaccaaa

SEQ ID NO: 69275 - RNA, 27 nt, Artificial Sequence
  Nucleolar complex protein 2 homolog (168-176)
aagcuguuccacgaggugguccaggcc

SEQ ID NO: 69276 - RNA, 30 nt, Artificial Sequence
  Unconventional myosin-Va (410-419)
aagcuguucaacuggaucguggacaauguc

SEQ ID NO: 69277 - RNA, 27 nt, Artificial Sequence
  Constitutive coactivator of PPAR-gamma-like protein 1 (805-813)
aagcuguuccagagcaaacuccuuaag

SEQ ID NO: 69278 - RNA, 30 nt, Artificial Sequence
  GTPase-activating protein and VPS9 domain-containing protein 1 (42-51)
aagcuguucagcgagggccucuuuuccgcc

SEQ ID NO: 69279 - RNA, 24 nt, Artificial Sequence
  Pleckstrin homology domain-containing family M member 2 (338-345)
aagcugggcgacaucagcgccgug

SEQ ID NO: 69280 - RNA, 27 nt, Artificial Sequence
  Atrial natriuretic peptide receptor 2 (148-156)
aagcugggcgaguucguggucacccuc

SEQ ID NO: 69281 - RNA, 24 nt, Artificial Sequence
  Destrin (151-158)
aagcugggcgggagccucaucgug

SEQ ID NO: 69282 - RNA, 24 nt, Artificial Sequence
  Transformation/transcription domain-associated protein (1157-1164)
aagcugggcgggguggucagcauc

SEQ ID NO: 69283 - RNA, 24 nt, Artificial Sequence
  Laminin subunit beta-2 (55-62)
aagcugggcaucgugcaggggauu

SEQ ID NO: 69284 - RNA, 27 nt, Artificial Sequence
  TRPM8 channel-associated factor 1 (281-289)
aagcugggccccuuccuccuuaacgcc

SEQ ID NO: 69285 - RNA, 36 nt, Artificial Sequence
  Transcription and mRNA export factor ENY2 (19-30)
aagcugaucgagaccggcgaaagagagaggcucaaa

SEQ ID NO: 69286 - RNA, 27 nt, Artificial Sequence
  Ral GTPase-activating protein subunit beta (194-202)
aagcugaucggcgugcucuucgagguc

SEQ ID NO: 69287 - RNA, 27 nt, Artificial Sequence
  Protein FAM179B (1545-1553)
aagcugaucaccggccuccuuaacgcc

SEQ ID NO: 69288 - RNA, 36 nt, Artificial Sequence
  L-lactate dehydrogenase B chain (308-319)
aagcugaaagacgaugagguggcccagcucaagaaa

SEQ ID NO: 69289 - RNA, 30 nt, Artificial Sequence
  Formin-1 (1119-1128)
aagcugcucgacaaacccgagcaguuccuu

SEQ ID NO: 69290 - RNA, 33 nt, Artificial Sequence
  Formin-1 (1119-1129)
aagcugcucgacaaacccgagcaguuccuucac

SEQ ID NO: 69291 - RNA, 30 nt, Artificial Sequence
  Inositol 1,4,5-trisphosphate receptor type 2 (474-483)
aagcugcucgaggaccuuaucuucuuugug

SEQ ID NO: 69292 - RNA, 30 nt, Artificial Sequence
  AP-3 complex delta subunit (1019-1028)
aagcugcucgagagcggcgaccuuuccaug

SEQ ID NO: 69293 - RNA, 33 nt, Artificial Sequence
  Catenin beta-1 (158-168)
aagcugcucaacgacgaggaucagguggucguu

SEQ ID NO: 69294 - RNA, 27 nt, Artificial Sequence
  Laminin subunit gamma-1 (646-654)
aagcugcucaacaaucuuaccagcauc

SEQ ID NO: 69295 - RNA, 30 nt, Artificial Sequence
  Laminin subunit gamma-1 (646-655)
aagcugcucaacaaucuuaccagcaucaaa

SEQ ID NO: 69296 - RNA, 30 nt, Artificial Sequence
  Dedicator of cytokinesis protein 5 (404-413)
aagcugcuccccggcgaccuuacccaggug

SEQ ID NO: 69297 - RNA, 30 nt, Artificial Sequence
  Myosin-10 (1002-1011)
aagcugauggaggacagaaucgccgaaugc

SEQ ID NO: 69298 - RNA, 27 nt, Artificial Sequence
  Heat shock protein HSP 90-beta (491-499)
aagcugaugaaagagauccucgacaag

SEQ ID NO: 69299 - RNA, 27 nt, Artificial Sequence
  Nuclear envelope integral membrane protein 1 (123-131)
aagcugaacgacaccuacgugaauguc

SEQ ID NO: 69300 - RNA, 27 nt, Artificial Sequence
  Zinc finger protein ZIC 1 (48-56)
aagcugaaccccagcucccacgagcuc

SEQ ID NO: 69301 - RNA, 27 nt, Artificial Sequence
  Lysine-specific histone demethylase 1A (609-617)
aagcugaacaccgccgugagacagguc

SEQ ID NO: 69302 - RNA, 24 nt, Artificial Sequence
  Probable ATP-dependent RNA helicase DDX60-like (1106-1113)
aagcugcccgccaucuucuuucuc

SEQ ID NO: 69303 - RNA, 27 nt, Artificial Sequence
  Probable ATP-dependent RNA helicase DDX60-like (1106-1114)
aagcugcccgccaucuucuuucucuuc

SEQ ID NO: 69304 - RNA, 24 nt, Artificial Sequence
  Probable ATP-dependent RNA helicase DDX60 (1126-1133)
aagcugcccgcccucuucuuucuu

SEQ ID NO: 69305 - RNA, 27 nt, Artificial Sequence
  Probable ATP-dependent RNA helicase DDX60 (1126-1134)
aagcugcccgcccucuucuuucuuuuc

SEQ ID NO: 69306 - RNA, 30 nt, Artificial Sequence
  Nuclear receptor coactivator 7 (189-198)
aagcugcccgacgccgaucucgcuagaaaa

SEQ ID NO: 69307 - RNA, 27 nt, Artificial Sequence
  Dolichyl-diphosphooligosaccharide-proteinosyltransferase 48 kDa subunit (380-388)
aagcugcccgacguguacggcgucuuc

SEQ ID NO: 69308 - RNA, 27 nt, Artificial Sequence
  Neuropathy target esterase (713-721)
aagcugcccgagggcacccucgggcac

SEQ ID NO: 69309 - RNA, 27 nt, Artificial Sequence
  von Willebrand factor A domain-containing protein 9 (368-376)
aagcugcccgagaaaacccagacauuc

SEQ ID NO: 69310 - RNA, 27 nt, Artificial Sequence
  Puratrophin-1 (608-616)
aagcugcccccugugggcagcaccgcc

SEQ ID NO: 69311 - RNA, 27 nt, Artificial Sequence
  MAU2 chromatid cohesion factor homolog (108-116)
aagcugcaggaggugcacccccuccuu

SEQ ID NO: 69312 - RNA, 27 nt, Artificial Sequence
  Myosin-10 (1284-1292)
aagcugcagaacgagcucgacaaugug

SEQ ID NO: 69313 - RNA, 27 nt, Artificial Sequence
  Unconventional myosin-If (409-417)
aagcugcagcaaaucuucauugagcuc

SEQ ID NO: 69314 - RNA, 33 nt, Artificial Sequence
  High affinity cAMP-specific and IBMX-insensitive 3',5'-cyclic phosphodiesterase 8B (264-274)
aagcugagagccugcaacagcguguucaccgcu

SEQ ID NO: 69315 - RNA, 27 nt, Artificial Sequence
  Laminin subunit beta-2 (210-218)
aagcugagcgcccacacccauacacuc

SEQ ID NO: 69316 - RNA, 30 nt, Artificial Sequence; identical to SEQ ID NO: 45089
  Nischarin (1228-1237)

SEQ ID NO: 69317 - RNA, 27 nt, Artificial Sequence
  Threonine synthase-like 2 (359-367)
aagcugagcgaggccgugaccuccguc

SEQ ID NO: 69318 - RNA, 27 nt, Artificial Sequence
  Rho GTPase-activating protein 7 (720-728)
aagcugagcgagaccuuccuccagauc

SEQ ID NO: 69319 - RNA, 24 nt, Artificial Sequence
  Myristoylated alanine-rich C-kinase substrate (165-172)
aagcugagcggcuucuccuuuaaa

SEQ ID NO: 69320 - RNA, 27 nt, Artificial Sequence
  Kinesin-1 heavy chain (222-230)
aagcugagcggcaaacucuaccuugug

SEQ ID NO: 69321 - RNA, 30 nt, Artificial Sequence
  Cathepsin D (348-357)
aagcugagccccgaggacuacacccucaaa

SEQ ID NO: 69322 - RNA, 27 nt, Artificial Sequence
  26S proteasome non-ATPase regulatory subunit 4 (83-91)
aagcugaccgccuucgugaacacacuc

SEQ ID NO: 69323 - RNA, 27 nt, Artificial Sequence
  Kinesin-like protein KIF13A (701-709)
aagcugaccgacuaccaggugacacuc

SEQ ID NO: 69324 - RNA, 27 nt, Artificial Sequence
  Cyclin-dependent kinase 2 (24-32)
aagcugaccggcgagguggucgcccuc

SEQ ID NO: 69325 - RNA, 27 nt, Artificial Sequence
  E3 ubiquitin-protein ligase UBR2 (543-551)
aagcugacccacgugaucagcaugaug

SEQ ID NO: 69326 - RNA, 27 nt, Artificial Sequence
  AP-1 complex subunit beta-1 (901-909)
aagcugaccaacggcaucugggugcuc

SEQ ID NO: 69327 - RNA, 27 nt, Artificial Sequence
  Copine-3 (110-118)
aagcugaccagaccccucgugaugaaa

SEQ ID NO: 69328 - RNA, 27 nt, Artificial Sequence
  Rab3 GTPase-activating protein non-catalytic subunit (337-345)
aagcugaccagcgcccucuucaacgcu

SEQ ID NO: 69329 - RNA, 27 nt, Artificial Sequence
  Endothelin B receptor (175-183)
aagcuggugcccuucauccagaaagcc

SEQ ID NO: 69330 - RNA, 27 nt, Artificial Sequence
  Platelet-activating factor acetylhydrolase IB subunit alpha (53-61)
aagcugugggacuuccagggcuuugag

SEQ ID NO: 69331 - RNA, 27 nt, Artificial Sequence
  Interleukin-24 (68-76)
aagcugugggaggccuucugggcugug

SEQ ID NO: 69332 - RNA, 27 nt, Artificial Sequence
  Coatomer subunit beta' (771-779)
aagcuguggagagagaaccucagcaaa

SEQ ID NO: 69333 - RNA, 27 nt, Artificial Sequence
  Cullin-9 (1503-1511)
aagcuguacgagcaccuccagagagcc

SEQ ID NO: 69334 - RNA, 27 nt, Artificial Sequence
  Phosphatidylinositol 4,5-bisphosphate 3-kinase catalytic subunit beta isoform (191-199)
aagcuguacggcgggaaacucaucgug

SEQ ID NO: 69335 - RNA, 33 nt, Artificial Sequence
  Protein FAM3C (30-40)
aagauggacgccagccugggcaaccucuucgcu

SEQ ID NO: 69336 - RNA, 30 nt, Artificial Sequence; identical to SEQ ID NO: 45109
  Dihydropyrimidinase-related protein 2 (338-347)

SEQ ID NO: 69337 - RNA, 36 nt, Artificial Sequence
  Splicing factor, arginine/serine-rich 19 (1112-1123)
aagauggaggaagccaaccuggcuagcagagcaaaa

SEQ ID NO: 69338 - RNA, 36 nt, Artificial Sequence
  Leucine-tRNA ligase, cytoplasmic (497-508)
aagaugaucgacgccggcgaugcucugauuuacaug

SEQ ID NO: 69339 - RNA, 33 nt, Artificial Sequence; identical to SEQ ID NO: 45112
  LisH domain-containing protein ARMC9 (259-269)

SEQ ID NO: 69340 - RNA, 30 nt, Artificial Sequence; identical to SEQ ID NO: 45113
  Neuron navigator 1 (1349-1358)

SEQ ID NO: 69341 - RNA, 27 nt, Artificial Sequence
  Eukaryotic translation initiation factor 3 subunit L (267-275)
aagaugcugggcuacuucagccucgug

SEQ ID NO: 69342 - RNA, 27 nt, Artificial Sequence
  KDEL motif-containing protein 1 (7-15)
aagaugcccgacguggagcuguucguc

SEQ ID NO: 69343 - RNA, 27 nt, Artificial Sequence
  Ceramide synthase 1 (98-106)
aagaugcccgagagcgccuggaaauuc

SEQ ID NO: 69344 - RNA, 39 nt, Artificial Sequence
  Amyloid-like protein 2 (688-700)
aagaugcagaaccacggcuacgagaaucccaccuauaaa

SEQ ID NO: 69345 - RNA, 39 nt, Artificial Sequence
  Gamma-secretase C-terminal fragment 59 (641-653)
aagaugcagcaaaacggcuacgagaaucccaccuauaaa

SEQ ID NO: 69346 - RNA, 33 nt, Artificial Sequence
  E3 ubiquitin-protein ligase UBR4 (905-915)
aagaugguggacggcgucgggguuugcaccgug

SEQ ID NO: 69347 - RNA, 27 nt, Artificial Sequence
  Polypyrimidine tract-binding protein 2 (415-423)
aagauguacggcaaaaucauuagagug

SEQ ID NO: 69348 - RNA, 30 nt, Artificial Sequence
  Protein diaphanous homolog 2 (637-646)
aagauguacaaacccgaggugagcaugaag

SEQ ID NO: 69349 - RNA, 27 nt, Artificial Sequence
  Nuclear pore complex protein Nup93 (510-518)
aagaacgccgacaaagugcuggagcuc

SEQ ID NO: 69350 - RNA, 27 nt, Artificial Sequence
  5'-nucleotidase domain-containing protein 1 (159-167)
aagaacgccggcaaaauccugcuccuu

SEQ ID NO: 69351 - RNA, 27 nt, Artificial Sequence
  60S ribosomal protein L13 (174-182)
aagaacuucaaagccuuugcuagccug

SEQ ID NO: 69352 - RNA, 27 nt, Artificial Sequence
  Centrosome-associated protein 350 (625-633)
aagaacaaaagacugcaggagcucuac

SEQ ID NO: 69353 - RNA, 27 nt, Artificial Sequence
  Aldehyde dehydrogenase family 1 member A3 (446-454)
aagaaccuggacaaagcccucaagcuu

SEQ ID NO: 69354 - RNA, 27 nt, Artificial Sequence
  Junction plakoglobin (278-286)
aagaacaaucccaaauuccuggccauc

SEQ ID NO: 69355 - RNA, 27 nt, Artificial Sequence
  COX assembly mitochondrial protein homolog (43-51)
aagaacagcggcgugcugauggucguu

SEQ ID NO: 69356 - RNA, 27 nt, Artificial Sequence
  Cytosolic acyl coenzyme A thioester hydrolase (126-134)
aagaacguggacaaaguccuggagguu

SEQ ID NO: 69357 - RNA, 27 nt, Artificial Sequence
  Synaptic vesicle membrane protein VAT-1 homolog (374-382)
aagaacgugggcaaaguccugcucguu

SEQ ID NO: 69358 - RNA, 27 nt, Artificial Sequence
  DnaJ homolog subfamily A member 4 (79-87)
aagaacgugguccaccagcugagcguu

SEQ ID NO: 69359 - RNA, 36 nt, Artificial Sequence
  Triosephosphate isomerase (156-167)
aagcccgaguucguggacaucauuaacgccaaacag

SEQ ID NO: 69360 - RNA, 27 nt, Artificial Sequence
  Rho GTPase-activating protein 7 (369-377)
aagcccggcaccuucccuaaagcccug

SEQ ID NO: 69361 - RNA, 27 nt, Artificial Sequence
  Anion exchange protein 3 (360-368)
aagccccacguggccagccuguccuuc

SEQ ID NO: 69362 - RNA, 21 nt, Artificial Sequence
  Kelch repeat and BTB domain-containing protein 6 (284-290)
aagcccaucgugaaaaaguac

SEQ ID NO: 69363 - RNA, 27 nt, Artificial Sequence
  Protein quaking (6-14)
aagcccaaaccuaccccagacuaccug

SEQ ID NO: 69364 - RNA, 27 nt, Artificial Sequence
  Sulfate transporter (548-556)
aagcccaaaagcucccugcucggccuu

SEQ ID NO: 69365 - RNA, 27 nt, Artificial Sequence
  Adenylate cyclase type 1 (422-430)
aagcccaacagcucccuggugguccuc

SEQ ID NO: 69366 - RNA, 21 nt, Artificial Sequence
  Serine/threonine-protein kinase tousled-like 1 (483-489)
aagcccccuaucauucacuac

SEQ ID NO: 69367 - RNA, 54 nt, Artificial Sequence
  NEDD4 family-interacting protein 1 (63-80)
aagcccccuagcuacaacguggccaccacacugccauccuaugacgaggcugaa

SEQ ID NO: 69368 - RNA, 27 nt, Artificial Sequence
  Plexin-D1 (92-100)
aagcccagaaaccugaaugugagcuuc

SEQ ID NO: 69369 - RNA, 33 nt, Artificial Sequence
  Collagen alpha-1(XV) chain (98-108)
aagcccagcuccaccagaggcggggugcuguuc

SEQ ID NO: 69370 - RNA, 63 nt, Artificial Sequence
  Nuclear pore complex protein Nup214 (1252-1272)
aagcccagcuacgaggccaucccugaauccucuccaccgucaggcauuaccagugcuagcaac

SEQ ID NO: 69371 - RNA, 27 nt, Artificial Sequence
  Phosphatidylinositol-binding clathrin assembly protein (465-473)
aagcccaccguggccagccagaaccaa

SEQ ID NO: 69372 - RNA, 27 nt, Artificial Sequence
  Lysyl oxidase homolog 3 (52-60)
aagcccuacgagggcagaguggaaauc

SEQ ID NO: 69373 - RNA, 27 nt, Artificial Sequence
  Nuclear factor of activated T-cells, cytoplasmic 2 (50-58)
aagcccuacagcccucuggccucccuc

SEQ ID NO: 69374 - RNA, 27 nt, Artificial Sequence
  Procollagen galactosyltransferase 1 (274-282)
aagcaggccgaggugcaaauguacguc

SEQ ID NO: 69375 - RNA, 30 nt, Artificial Sequence
  Syntaxin-binding protein 6 (78-87)
aagcaguucgagggcagcaccuccuuugug

SEQ ID NO: 69376 - RNA, 30 nt, Artificial Sequence
  Dystonin (5209-5218)
aagcagaaagagaccaucaaggccuuccug

SEQ ID NO: 69377 - RNA, 27 nt, Artificial Sequence
  EAW49110.1 (48-56)
aagcagcuggaggacggcagaagccuc

SEQ ID NO: 69378 - RNA, 27 nt, Artificial Sequence
  E3 ubiquitin-protein ligase RNF130 (159-167)
aagcagaacgacguggucagaauccug

SEQ ID NO: 69379 - RNA, 27 nt, Artificial Sequence
  Putative signal peptidase complex catalytic subunit SEC11B (91-99)
aagcagaacggccacaucaaauuccug

SEQ ID NO: 69380 - RNA, 27 nt, Artificial Sequence
  Unconventional myosin-IXa (65-73)
aagcagcccgaggaauaccacuaucug

SEQ ID NO: 69381 - RNA, 27 nt, Artificial Sequence
  Rho guanine nucleotide exchange factor 2 (208-216)
aagcagcaagacgugaucuacgagcug

SEQ ID NO: 69382 - RNA, 48 nt, Artificial Sequence
  Heat shock 70 kDa protein 4 (754-769)
aagcagagccugaccauggaccccguggucaaauccaaggagaucgaa

SEQ ID NO: 69383 - RNA, 30 nt, Artificial Sequence
  Serum albumin (549-558)
aagcagaccgcccugguggagcucgucaaa

SEQ ID NO: 69384 - RNA, 30 nt, Artificial Sequence
  Tyrosine-protein kinase Fer (613-622)
aagcaguacgaccaccccaacaucgugaaa

SEQ ID NO: 69385 - RNA, 27 nt, Artificial Sequence
  Transmembrane emp24 domain-containing protein 3 (83-91)
aagcaguacgacagcuucaccuauaga

SEQ ID NO: 69386 - RNA, 36 nt, Artificial Sequence
  Protein Niban (482-493)
aagcaguacgacuaugauagcuccaccaucagaaaa

SEQ ID NO: 69387 - RNA, 39 nt, Artificial Sequence
  Protein Niban (482-494)
aagcaguacgacuaugauagcuccaccaucagaaaaaag

SEQ ID NO: 69388 - RNA, 27 nt, Artificial Sequence
  Phosphatidylinositol 3,4,5-trisphosphate-dependent Rac exchanger 1 protein (1094-1102)
aagcaguacgugacccaaaucaacaga

SEQ ID NO: 69389 - RNA, 27 nt, Artificial Sequence
  Unconventional myosin-Ib (37-45)
aagagauucgaccacagcgagaucuac

SEQ ID NO: 69390 - RNA, 27 nt, Artificial Sequence
  Serine/threonine-protein kinase 10 (596-604)
aagagauucgagcaggaaaucaacgcc

SEQ ID NO: 69391 - RNA, 24 nt, Artificial Sequence
  60S ribosomal protein L10a (47-54)
aagagauucagcggcaccgugagg

SEQ ID NO: 69392 - RNA, 27 nt, Artificial Sequence
  Copine-1 (190-198)
aagagauucagcgugcccguccagcac

SEQ ID NO: 69393 - RNA, 30 nt, Artificial Sequence
  MAP/microtubule affinity-regulating kinase 3 (731-740)
aagagaaucagcggcaccuccauugccuuc

SEQ ID NO: 69394 - RNA, 27 nt, Artificial Sequence
  Intraflagellar transport protein 81 homolog (264-272)
aagagacuggaggaagagaucaaauuc

SEQ ID NO: 69395 - RNA, 30 nt, Artificial Sequence
  ATP-dependent RNA helicase A (30-39)
aagagacugggcuacauccacaggaacuuc

SEQ ID NO: 69396 - RNA, 27 nt, Artificial Sequence
  Maltase-glucoamylase (110-118)
aagagacugcccagcccuucccucuuc

SEQ ID NO: 69397 - RNA, 27 nt, Artificial Sequence
  Serum albumin (468-476)
aagagaaugcccugcgccgaggacuac

SEQ ID NO: 69398 - RNA, 27 nt, Artificial Sequence
  Gamma-interferon-inducible protein 16 (202-210)
aagagacccgugaucgucaaaguucug

SEQ ID NO: 69399 - RNA, 27 nt, Artificial Sequence
  Band 4.1-like protein 2 (451-459)
aagagaagcaacuucuacaucaaagug

SEQ ID NO: 69400 - RNA, 42 nt, Artificial Sequence
  Glyceraldehyde-3-phosphate dehydrogenase (117-130)
aagagagugaucauuagcgcccccuccgcugacgcaccuaug

SEQ ID NO: 69401 - RNA, 27 nt, Artificial Sequence
  Glia-derived nexin (299-307)
aagagagugcaggucauccugcccaaa

SEQ ID NO: 69402 - RNA, 27 nt, Artificial Sequence
  Growth/differentiation factor 15 (45-53)
aagagauacgaggaccugcucaccagg

SEQ ID NO: 69403 - RNA, 27 nt, Artificial Sequence
  Insulin-like growth factor 1 receptor (927-935)
aagagauacgagaacuucauccaccug

SEQ ID NO: 69404 - RNA, 27 nt, Artificial Sequence
  Protein zyg-11 homolog B (68-76)
aagagauacagcgagagggccuucuuu

SEQ ID NO: 69405 - RNA, 30 nt, Artificial Sequence
  Glycerol-3-phosphate acyltransferase 4 (407-416)
aagagcgccaucgcuagacagggcgggcug

SEQ ID NO: 69406 - RNA, 27 nt, Artificial Sequence
  Centrosomal protein C10orf90 (33-41)
aagagcgacuucaccaaagagacacug

SEQ ID NO: 69407 - RNA, 30 nt, Artificial Sequence
  Transcriptional protein SWT1 (56-65)
aagagcgaccacaccgaugugcuguacuau

SEQ ID NO: 69408 - RNA, 27 nt, Artificial Sequence
  78 kDa glucose-regulated protein (335-343)
aagagcgacaucgaugagauugugcug

SEQ ID NO: 69409 - RNA, 27 nt, Artificial Sequence
  Copine-9 (167-175)
aagagcgaccccuuccugguguuuuac

SEQ ID NO: 69410 - RNA, 27 nt, Artificial Sequence
  Pre-mRNA-processing factor 40 homolog A (164-172)
aagagcgacuccggcaaacccuacuau

SEQ ID NO: 69411 - RNA, 48 nt, Artificial Sequence
  Serine/threonine-protein phosphatase 2A 65 kDa regulatory subunit A alpha isoform (202-217)
aagagcgagaucauucccauguucuccaaccuggccucugacgaacag

SEQ ID NO: 69412 - RNA, 27 nt, Artificial Sequence
  Minor histocompatibility antigen H13 (234-242)
aagagcuucgaggcccccaucaaacug

SEQ ID NO: 69413 - RNA, 54 nt, Artificial Sequence
  Protein HEG homolog 1 (147-164)
aagagcggcgacuuccagaugucccccuacgccgaguauccuaaaaacccaaga

SEQ ID NO: 69414 - RNA, 27 nt, Artificial Sequence
  Protein LAP2 (860-868)
aagagcggccccgugggguccgucguu

SEQ ID NO: 69415 - RNA, 24 nt, Artificial Sequence
  Vacuolar protein sorting-associated protein 16 homolog (82-89)
aagagcggccccguggucucccug

SEQ ID NO: 69416 - RNA, 27 nt, Artificial Sequence
  Alpha-catulin (373-381)
aagagcaucgccgaggaacuggagcuc

SEQ ID NO: 69417 - RNA, 27 nt, Artificial Sequence
  60S ribosomal protein L35 (52-60)
aagagcaucgccagagugcugaccguc

SEQ ID NO: 69418 - RNA, 27 nt, Artificial Sequence
  Syntenin-1 (130-138)
aagagcaucgacaacggcauuuucgug

SEQ ID NO: 69419 - RNA, 27 nt, Artificial Sequence
  Protein disulfide-isomerase TMX3 (71-79)
aagagcaucggcucccccgugaaaguc

SEQ ID NO: 69420 - RNA, 27 nt, Artificial Sequence
  Protein RTF2 homolog (83-91)
aagagcaucaaaaacgugaccgagcug

SEQ ID NO: 69421 - RNA, 27 nt, Artificial Sequence
  Adenylosuccinate synthetase isozyme 2 (203-211)
aagagcaucuaccccacccuggagauu

SEQ ID NO: 69422 - RNA, 27 nt, Artificial Sequence
  Selenoprotein N (53-61)
aagagcaaagacggcuuccugggggug

SEQ ID NO: 69423 - RNA, 30 nt, Artificial Sequence
  Nucleolar pre-ribosomal-associated protein 1 (429-438)
aagagccugaccaaacuccuuaucaugaag

SEQ ID NO: 69424 - RNA, 27 nt, Artificial Sequence
  Astrotactin-2 (499-507)
aagagcaugcccuucaucaccuaccug

SEQ ID NO: 69425 - RNA, 33 nt, Artificial Sequence
  Transmembrane protein 98 (144-154)
aagagcauguaccccccucuggacccaaaacuc

SEQ ID NO: 69426 - RNA, 27 nt, Artificial Sequence
  CD44 antigen (303-311)
aagagccaggagauggugcaccugguc

SEQ ID NO: 69427 - RNA, 27 nt, Artificial Sequence
  Targeting protein for Xklp2 (686-694)
aagagcuccgaccagccccugaccgug

SEQ ID NO: 69428 - RNA, 27 nt, Artificial Sequence
  Chromodomain-helicase-DNA-binding protein 1 (88-96)
aagagcucccccucuauccuggccgug

SEQ ID NO: 69429 - RNA, 27 nt, Artificial Sequence
  Leucine-tRNA ligase, cytoplasmic (28-36)
aagagcaccggcaacuuccugacacuc

SEQ ID NO: 69430 - RNA, 27 nt, Artificial Sequence
  116 kDa U5 small nuclear ribonucleoprotein component (182-190)
aagagcacccccgugacagucguucug

SEQ ID NO: 69431 - RNA, 27 nt, Artificial Sequence
  Lysosome-associated membraneoprotein 2 (402-410)
aagagcuacgccggcuaucagacccug

SEQ ID NO: 69432 - RNA, 27 nt, Artificial Sequence
  2',3'-cyclic-nucleotide 3'-phosphodiesterase (256-264)
aagagcuacuccaaagccuucacccug

SEQ ID NO: 69433 - RNA, 27 nt, Artificial Sequence
  Zinc finger protein ZIC 2 (401-409)
aagagcuacacccaccccuccucucug

SEQ ID NO: 69434 - RNA, 24 nt, Artificial Sequence
  Ubiquitin carboxyl-terminal hydrolase 8 (34-41)
aagagcuacgugcacuccgcccug

SEQ ID NO: 69435 - RNA, 27 nt, Artificial Sequence
  Peptidyl-prolyl cis-trans isomerase A (31-39)
aagaccgccgagaacuucagagcucug

SEQ ID NO: 69436 - RNA, 27 nt, Artificial Sequence
  Endothelin B receptor (359-367)
aagaccgccaaagacugguggcuguuc

SEQ ID NO: 69437 - RNA, 27 nt, Artificial Sequence
  V-type proton ATPase 116 kDa subunit a isoform 4 (360-368)
aagaccgcccccccuacauucaacaga

SEQ ID NO: 69438 - RNA, 27 nt, Artificial Sequence
  RAC-gamma serine/threonine-protein kinase (32-40)
aagaccgacggcagcuucaucggguac

SEQ ID NO: 69439 - RNA, 33 nt, Artificial Sequence
  Growth/differentiation factor 15 (274-284)
aagaccgacacaggcgugagccugcagacuuac

SEQ ID NO: 69440 - RNA, 51 nt, Artificial Sequence
  Myeloid-derived growth factor (132-148)
aagaccgaggaauucgaggugacaaaaacugccgucgcucacagacccggc

SEQ ID NO: 69441 - RNA, 27 nt, Artificial Sequence
  Myosin-IIIb (442-450)
aagaccgagagcgcccaccugaucgug

SEQ ID NO: 69442 - RNA, 27 nt, Artificial Sequence
  Cullin-4B (327-335)
aagaccaucgacggcauucugcuccuu

SEQ ID NO: 69443 - RNA, 27 nt, Artificial Sequence
  UPF0769 protein C21orf59 (114-122)
aagaccaucgaggaagccaaagcuauu

SEQ ID NO: 69444 - RNA, 30 nt, Artificial Sequence
  Protein FAM184A (180-189)
aagaccaucggcaaacugaagacagagcuc

SEQ ID NO: 69445 - RNA, 27 nt, Artificial Sequence
  Probable C-mannosyltransferase DPY19L4 (129-137)
aagaccaucaacgccgugcagcaaaug

SEQ ID NO: 69446 - RNA, 27 nt, Artificial Sequence
  Transcription factor SOX-8 (16-24)
aagacccugggcaaacucuggagacuu

SEQ ID NO: 69447 - RNA, 24 nt, Artificial Sequence
  Transcription factor Dp-2 (49-56)
aagacccugggccccaucaacgug

SEQ ID NO: 69448 - RNA, 60 nt, Artificial Sequence
  Uncharacterized protein KIAA1109 (4603-4622)
aagaccaugacaagcaaccuggagaaauccucucaggaacaacuccuugacgccgcucac

SEQ ID NO: 69449 - RNA, 27 nt, Artificial Sequence
  Catenin beta-1 (288-296)
aagaccaacgugaaauuccuggccauc

SEQ ID NO: 69450 - RNA, 24 nt, Artificial Sequence
  RNA-binding protein Raly (143-150)
aagaccaacgugcccgucaaacug

SEQ ID NO: 69451 - RNA, 27 nt, Artificial Sequence
  THO complex subunit 2 (892-900)
aagacccccaacuucagcacacugcuc

SEQ ID NO: 69452 - RNA, 27 nt, Artificial Sequence
  HEAT repeat-containing protein 2 (446-454)
aagacccccagcgccuccggccugcuc

SEQ ID NO: 69453 - RNA, 27 nt, Artificial Sequence
  Eukaryotic translation initiation factor 4 gamma 1 (717-725)
aagacccaggaccuguucagaagggug

SEQ ID NO: 69454 - RNA, 27 nt, Artificial Sequence
  Angiomotin-like protein 1 (332-340)
aagacccaggagcacggccuguucuac

SEQ ID NO: 69455 - RNA, 27 nt, Artificial Sequence
  Cohesin subunit SA-2 (965-973)
aagaccagagaggccaucgcuaugcug

SEQ ID NO: 69456 - RNA, 24 nt, Artificial Sequence
  Golgin subfamily B member 1 (382-389)
aagaccagccacauccugucccuc

SEQ ID NO: 69457 - RNA, 24 nt, Artificial Sequence
  ATP-binding cassette sub-family F member 3 (144-151)
aagaccagcaacccccuggugcuc

SEQ ID NO: 69458 - RNA, 27 nt, Artificial Sequence
  Hemicentin-1 (971-979)
aagaccacaagcguggucguucacgug

SEQ ID NO: 69459 - RNA, 27 nt, Artificial Sequence
  Vigilin (294-302)
aagaccacaacuaucgccguggagguc

SEQ ID NO: 69460 - RNA, 24 nt, Artificial Sequence
  Rab3 GTPase-activating protein non-catalytic subunit (1174-1181)
aagaccgugaaaccccugagccuc

SEQ ID NO: 69461 - RNA, 27 nt, Artificial Sequence
  40S ribosomal protein S11 (136-144)
aagaccgugagauucaacguccugaaa

SEQ ID NO: 69462 - RNA, 30 nt, Artificial Sequence; identical to SEQ ID NO: 45235
  Melanocyte protein PMEL (154-163)

SEQ ID NO: 69463 - RNA, 27 nt, Artificial Sequence
  Spermidine synthase (57-65)
aagaccuacggcaacgugcugguccuc

SEQ ID NO: 69464 - RNA, 39 nt, Artificial Sequence
  26S protease regulatory subunit 7 (34-46)
aagaccuacggccagagcacauauuccagacaaaucaaa

SEQ ID NO: 69465 - RNA, 27 nt, Artificial Sequence
  Cyclin-dependent kinase 16 (470-478)
aagaccuacaacuaucccaaauacaga

SEQ ID NO: 69466 - RNA, 27 nt, Artificial Sequence
  Non-receptor tyrosine-protein kinase TNK1 (260-268)
aagguggccgacuucggccuggucaga

SEQ ID NO: 69467 - RNA, 27 nt, Artificial Sequence
  GMP synthase (glutamine-hydrolyzing) (292-300)
aagguggccgacggcuucaaagucguu

SEQ ID NO: 69468 - RNA, 27 nt, Artificial Sequence
  Dynactin subunit 3 (32-40)
aagguggccgacggccuggucaaaguu

SEQ ID NO: 69469 - RNA, 27 nt, Artificial Sequence
  Phosphoglycerate kinase 1 (216-224)
aagguggccgacaaaauccagcugauu

SEQ ID NO: 69470 - RNA, 27 nt, Artificial Sequence
  Disks large homolog 1 (368-376)
aagguggccaaacccaccagcauguac

SEQ ID NO: 69471 - RNA, 30 nt, Artificial Sequence
  GPI mannosyltransferase 1 (15-24)
aagguggcccccgcuggcgucuucgggguu

SEQ ID NO: 69472 - RNA, 36 nt, Artificial Sequence
  Coatomer subunit delta (123-134)
aagguggcccccgcuccugcaagaccaagcggcccg

SEQ ID NO: 69473 - RNA, 27 nt, Artificial Sequence
  Asparagine synthetase (glutamine-hydrolyzing) (112-120)
aagguggccagcgucgagaugguuaaa

SEQ ID NO: 69474 - RNA, 69 nt, Artificial Sequence
  Pyridoxal kinase (152-174)
aagguggacgccgucuucguuggcaccggggaucuguuugcugcaaugcuccuugccuggacacacaaa

SEQ ID NO: 69475 - RNA, 27 nt, Artificial Sequence
  Melanoma-associated antigen 4 (113-121)
aagguggacgagcuggcccacuuccuc

SEQ ID NO: 69476 - RNA, 27 nt, Artificial Sequence
  Centromere protein F (738-746)
aagguggacgagcugaccacagaaauc

SEQ ID NO: 69477 - RNA, 27 nt, Artificial Sequence
  Beta-secretase 2 (314-322)
aagguguucgacgccgucguugaggcu

SEQ ID NO: 69478 - RNA, 27 nt, Artificial Sequence
  Transcription factor HES-1 (214-222)
aagguguucggcggguuucaggucguu

SEQ ID NO: 69479 - RNA, 24 nt, Artificial Sequence
  Myelin expression factor 2 (123-130)
aaggugggcgaggucaccuacguu

SEQ ID NO: 69480 - RNA, 24 nt, Artificial Sequence
  Uridine phosphorylase 1 (99-106)
aaggugggccccguccugagcguu

SEQ ID NO: 69481 - RNA, 33 nt, Artificial Sequence
  Nucleosome-remodeling factor subunit BPTF (2095-2105)
aaggugggcagccccgccaccgucacauuccag

SEQ ID NO: 69482 - RNA, 18 nt, Artificial Sequence
  E3 ubiquitin/ISG15 ligase TRIM25 (596-601)
aaggugcaccugauguac

SEQ ID NO: 69483 - RNA, 30 nt, Artificial Sequence
  Unconventional myosin-Id (255-264)
aaggugaucggcuucaaacccgaggaaauu

SEQ ID NO: 69484 - RNA, 39 nt, Artificial Sequence
  Titin (15654-15666)
aaggugaaagaggucaccaagacaagcguuacucugacg

SEQ ID NO: 69485 - RNA, 27 nt, Artificial Sequence
  Fructose-bisphosphate aldolase A (262-270)
aaggugcuggccgcugucuacaaagca

SEQ ID NO: 69486 - RNA, 153 nt, Artificial Sequence
  Titin (21056-21106)
aaggugcuggacacccccgccgcuugccagaaacuccaagucaagcacguuagcagaggcacagugacucuucugugggauccuccauugaucgacgggggauccccgauuauaaacuacguaaucgagaaaagggaugcaacgaagcggacc

SEQ ID NO: 69487 - RNA, 33 nt, Artificial Sequence
  F-box only protein 32 (98-108)
aaggugcuggaggaccagcaaaacaucagacuc

SEQ ID NO: 69488 - RNA, 27 nt, Artificial Sequence
  Melanoma-associated antigen 4 (286-294)
aaggugcuggagcacgucguuagagug

SEQ ID NO: 69489 - RNA, 27 nt, Artificial Sequence
  Chloride transport protein 6 (183-191)
aaggugcugggcguccucuucagcguu

SEQ ID NO: 69490 - RNA, 27 nt, Artificial Sequence
  SLIT-ROBO Rho GTPase-activating protein 2 (155-163)
aaggugcugaacgagcucuacagcguc

SEQ ID NO: 69491 - RNA, 27 nt, Artificial Sequence
  Signal recognition particle receptor subunit alpha (345-353)
aaggugaugggcaccuucagcacaguc

SEQ ID NO: 69492 - RNA, 27 nt, Artificial Sequence
  40S ribosomal protein S16 (32-40)
aaggugaacggcagaccccuggagaug

SEQ ID NO: 69493 - RNA, 24 nt, Artificial Sequence
  E3 ubiquitin-protein ligase RING1 (361-368)
aaggugagcagaccccuggagcuc

SEQ ID NO: 69494 - RNA, 27 nt, Artificial Sequence
  Solute carrier family 41 member 2 (192-200)
aaggugaccgaggucuucauccugguu

SEQ ID NO: 69495 - RNA, 27 nt, Artificial Sequence
  Hom s 1 (524-532)
aagguggucgagaucguuaaaaagcug

SEQ ID NO: 69496 - RNA, 18 nt, Artificial Sequence
  Poly (ADP-ribose) polymerase 12 (512-517)
aagguguggaaccuguuc

SEQ ID NO: 69497 - RNA, 30 nt, Artificial Sequence
  Unconventional myosin-Id (707-716)
aagguguggagaggcacccuggccaggaug

SEQ ID NO: 69498 - RNA, 30 nt, Artificial Sequence
  Hemicentin-1 (2662-2671)
aagguguacauccccccuauuauaaacaaa

SEQ ID NO: 69499 - RNA, 27 nt, Artificial Sequence
  Probable helicase with zinc finger domain (500-508)
aaguacgcccagaacggccaacuguuc

SEQ ID NO: 69500 - RNA, 27 nt, Artificial Sequence
  DNA cross-link repair 1A protein (370-378)
aaguacgacgagggccuguauagauuc

SEQ ID NO: 69501 - RNA, 27 nt, Artificial Sequence
  EH domain-containing protein 2 (452-460)
aaguacgacgagaucuucuauaaccug

SEQ ID NO: 69502 - RNA, 27 nt, Artificial Sequence
  E3 ubiquitin-protein ligase SIAH1 (198-206)
aaguacgacggccaccagcaauucuuu

SEQ ID NO: 69503 - RNA, 27 nt, Artificial Sequence
  Dedicator of cytokinesis protein 4 (92-100)
aaguacggcgacaugagagugaccaug

SEQ ID NO: 69504 - RNA, 24 nt, Artificial Sequence
  Serine/threonine-protein kinase PLK2 (513-520)
aaguacggcuucggguaucagcug

SEQ ID NO: 69505 - RNA, 27 nt, Artificial Sequence
  Protein SOGA1 (415-423)
aaguacggcaucgugcaggaguucuuu

SEQ ID NO: 69506 - RNA, 24 nt, Artificial Sequence
  Glycerol-3-phosphate acyltransferase 4 (365-372)
aaguacggcauggugaccuaucug

SEQ ID NO: 69507 - RNA, 27 nt, Artificial Sequence
  RNA-binding motif protein, X chromosome (30-38)
aaguacggcagaaucguggagguccug

SEQ ID NO: 69508 - RNA, 27 nt, Artificial Sequence
  Non-specific lipid-transfer protein (92-100)
aaguacggcaccaaaaucgagcacuuc

SEQ ID NO: 69509 - RNA, 30 nt, Artificial Sequence
  Paired amphipathic helix protein Sin3b (300-309)
aaguacggcacccugcaggaguucagcuuu

SEQ ID NO: 69510 - RNA, 27 nt, Artificial Sequence
  Kinase D-interacting substrate of 220 kDa (126-134)
aaguacggcaccacaccccuggugugg

SEQ ID NO: 69511 - RNA, 27 nt, Artificial Sequence
  Peroxisome proliferator-activated receptor delta isoform 4 (185-193)
aaguacggcgugcacgaggccaucuuc

SEQ ID NO: 69512 - RNA, 27 nt, Artificial Sequence
  Tubulin-tyrosine ligase-like protein 12 (451-459)
aaguacaucgagagccccgugcuguuc

SEQ ID NO: 69513 - RNA, 27 nt, Artificial Sequence
  Protein yippee-like 3 (104-112)
aaguacaucauugagcugaaccacaug

SEQ ID NO: 69514 - RNA, 27 nt, Artificial Sequence
  3-hydroxy-3-methylglutaryl-coenzyme A reductase (89-97)
aaguacauccugggcauugccgggcuc

SEQ ID NO: 69515 - RNA, 27 nt, Artificial Sequence
  Alpha-fetoprotein (403-411)
aaguacauccaggagagccaagcccug

SEQ ID NO: 69516 - RNA, 27 nt, Artificial Sequence
  Membrane progestin receptor alpha (193-201)
aaguacauccagaaacccggccugcuc

SEQ ID NO: 69517 - RNA, 27 nt, Artificial Sequence
  Centrosomal protein of 135 kDa (857-865)
aaguacaucaccgaggugagcagaugg

SEQ ID NO: 69518 - RNA, 27 nt, Artificial Sequence
  Transmembrane emp24 domain-containing protein 5 (84-92)
aaguacaucaccggcacagacauucug

SEQ ID NO: 69519 - RNA, 27 nt, Artificial Sequence
  Kinesin light chain 1 (266-274)
aaguacaaagacgccgcuaaccugcuc

SEQ ID NO: 69520 - RNA, 27 nt, Artificial Sequence
  Melanoma-associated antigen B1 (141-149)
aaguacaaagaccacuucaccgagauc

SEQ ID NO: 69521 - RNA, 27 nt, Artificial Sequence
  Melanoma-associated antigen C2 (173-181)
aaguacaaagacuauuuccccgugauc

SEQ ID NO: 69522 - RNA, 27 nt, Artificial Sequence
  Kinesin light chain 4 (191-199)
aaguacaaagaggccgcucaccugcuc

SEQ ID NO: 69523 - RNA, 27 nt, Artificial Sequence
  Antizyme inhibitor 1 (341-349)
aaguacaaagaggacgaaccccuguuc

SEQ ID NO: 69524 - RNA, 27 nt, Artificial Sequence
  Protein disulfide-isomerase (91-99)
aaguacaaacccgagagcgaagagcug

SEQ ID NO: 69525 - RNA, 27 nt, Artificial Sequence
  Peroxisomal acyl-coenzyme A oxidase 3 (120-128)
aaguaccugcuccacagccuuguguuc

SEQ ID NO: 69526 - RNA, 27 nt, Artificial Sequence
  Gem-associated protein 4 (188-196)
aaguaccugcccgcccucgacgaguuc

SEQ ID NO: 69527 - RNA, 33 nt, Artificial Sequence
  Phosphatidylinositol-glycan biosynthesis class W protein (189-199)
aaguacauggagggcagcaaacugcacuauuuc

SEQ ID NO: 69528 - RNA, 30 nt, Artificial Sequence
  Histone acetyltransferase type B catalytic subunit (207-216)
aaguacaacaaagacggcgccacccuguuc

SEQ ID NO: 69529 - RNA, 27 nt, Artificial Sequence
  Formin-like protein 3 (158-166)
aaguaccccgaccuggccaacuucugg

SEQ ID NO: 69530 - RNA, 27 nt, Artificial Sequence
  Rho guanine nucleotide exchange factor 12 (939-947)
aaguacccccugcuccuugacaacauc

SEQ ID NO: 69531 - RNA, 27 nt, Artificial Sequence
  Rho guanine nucleotide exchange factor 11 (884-892)
aaguacccccugcuccuugagagcauc

SEQ ID NO: 69532 - RNA, 27 nt, Artificial Sequence
  Protein lifeguard 4 (139-147)
aaguacccccugaaccucuaucuucug

SEQ ID NO: 69533 - RNA, 27 nt, Artificial Sequence
  Ceramide glucosyltransferase (104-112)
aaguaccccaacguggacgccagacug

SEQ ID NO: 69534 - RNA, 21 nt, Artificial Sequence
  ATP-dependent RNA helicase A (169-175)
aaguaccccagcccuuucuuu

SEQ ID NO: 69535 - RNA, 27 nt, Artificial Sequence
  Early endosome antigen 1 (387-395)
aaguaccagcaccugaaagccgaguuc

SEQ ID NO: 69536 - RNA, 27 nt, Artificial Sequence
  Tetratricopeptide repeat protein 9C (156-164)
aaguacagagacgccgugagcagguau

SEQ ID NO: 69537 - RNA, 27 nt, Artificial Sequence
  Zinc finger protein ZFAT (350-358)
aaguacagcgacgugaaaaaccugauc

SEQ ID NO: 69538 - RNA, 27 nt, Artificial Sequence
  Host cell factor 1 (105-113)
aaguacagcaacgaccuguaugagcuc

SEQ ID NO: 69539 - RNA, 27 nt, Artificial Sequence
  Serine-protein kinase ATM (331-339)
aaguacagcuccggcuucagaaacauc

SEQ ID NO: 69540 - RNA, 27 nt, Artificial Sequence
  Zinc finger MYM-type protein 4 (1301-1309)
aaguacagcaccaaaaugacauaucug

SEQ ID NO: 69541 - RNA, 72 nt, Artificial Sequence
  Actin, gamma-enteric smooth muscle (294-317)
aaguacagcguguggaucggcggguccauucuggccucucucucaaccuuccagcaaauguggauaaguaaa

SEQ ID NO: 69542 - RNA, 27 nt, Artificial Sequence
  DNA/RNA-binding protein KIN17 (311-319)
aaguacaccgccguggucaaaaugauc

SEQ ID NO: 69543 - RNA, 27 nt, Artificial Sequence
  Signal peptidase complex subunit 2 (73-81)
aaguacguggagaacuucggccugauc

SEQ ID NO: 69544 - RNA, 27 nt, Artificial Sequence
  Sorting nexin-29 (103-111)
aaguacgugggcgccguccagaugcug

SEQ ID NO: 69545 - RNA, 24 nt, Artificial Sequence
  Zinc finger protein 195 (148-155)
aaguacgugaaaaucuucgacaac

SEQ ID NO: 69546 - RNA, 27 nt, Artificial Sequence
  Zinc finger protein 92 (117-125)
aaguacgugaaagucuuccacaaguuu

SEQ ID NO: 69547 - RNA, 27 nt, Artificial Sequence
  Zinc finger protein 708 (80-88)
aaguacgugaaagucuuccacaaguau

SEQ ID NO: 69548 - RNA, 27 nt, Artificial Sequence
  Tubulin beta chain (78-86)
aaguacgugcccagagccauccugguc

SEQ ID NO: 69549 - RNA, 27 nt, Artificial Sequence
  Centromere/kinetochore protein zw10 homolog (130-138)
aaguacgugaccggcgcccagagacug

SEQ ID NO: 69550 - RNA, 27 nt, Artificial Sequence
  Ubiquitin carboxyl-terminal hydrolase 8 (65-73)
aaguacgugaccgucuauaaccugauc

SEQ ID NO: 69551 - RNA, 27 nt, Artificial Sequence
  Digestive organ expansion factor homolog (526-534)
aaguacuauagacagacccugcucuuc

SEQ ID NO: 69552 - RNA, 30 nt, Artificial Sequence
  Probable E3 ubiquitin-protein ligase HERC1 (3206-3215)
cuggccgcuggccucgagagccuugggcug

SEQ ID NO: 69553 - RNA, 33 nt, Artificial Sequence
  Glutamate receptor ionotropic, kainate 2 (827-837)
cuggccgcuggccucgugcuuagcgucuucguu

SEQ ID NO: 69554 - RNA, 27 nt, Artificial Sequence
  Ankyrin repeat domain-containing protein 17 (848-856)
cuggccgcuggcccccucccuccaggg

SEQ ID NO: 69555 - RNA, 24 nt, Artificial Sequence
  Spectrin beta chain, non-erythrocytic 4 (1779-1786)
cuggccgcugugaaccagaugguc

SEQ ID NO: 69556 - RNA, 27 nt, Artificial Sequence
  Vimentin (88-96)
cuggccgacgcuaucaacaccgaguuc

SEQ ID NO: 69557 - RNA, 27 nt, Artificial Sequence
  Exonuclease 3'-5' domain-containing protein 2 (31-39)
cuggccgacggcaccauccucaaggug

SEQ ID NO: 69558 - RNA, 27 nt, Artificial Sequence
  Kinesin-associated protein 3 (289-297)
cuggccgaggacaccagaacagaacuc

SEQ ID NO: 69559 - RNA, 24 nt, Artificial Sequence
  Kinectin (601-608)
cuggccgaggaacuccacaaggug

SEQ ID NO: 69560 - RNA, 24 nt, Artificial Sequence
  CREB-binding protein (654-661)
cuggccgagaagaucuacaaaauu

SEQ ID NO: 69561 - RNA, 24 nt, Artificial Sequence
  Protein shisa-4 (79-86)
cuggccuucagccccaagaccauc

SEQ ID NO: 69562 - RNA, 24 nt, Artificial Sequence
  DNA-dependent protein kinase catalytic subunit (29-36)
cuggccggccaccagcucaucaga

SEQ ID NO: 69563 - RNA, 30 nt, Artificial Sequence
  Signal transducer and activator of transcription 3 (221-230)
cuggccggccuccuuagcgcuauggaguac

SEQ ID NO: 69564 - RNA, 27 nt, Artificial Sequence
  Phosphoacetylglucosamine mutase (519-527)
cuggcccacgaggugagccucgcuguc

SEQ ID NO: 69565 - RNA, 33 nt, Artificial Sequence
  Ancient ubiquitous protein 1 (320-330)
cuggccaagaccggcugcguggaccucacaauc

SEQ ID NO: 69566 - RNA, 27 nt, Artificial Sequence
  Splicing factor 3B subunit 3 (765-773)
cuggcccucgagaagcuuggcgcugug

SEQ ID NO: 69567 - RNA, 24 nt, Artificial Sequence
  EH domain-containing protein 1 (503-510)
cuggccaaccaccucaucaaggug

SEQ ID NO: 69568 - RNA, 24 nt, Artificial Sequence
  Alpha-2-macroglobulin-like protein 1 (37-44)
cuggcccccgacccuagccucgug

SEQ ID NO: 69569 - RNA, 24 nt, Artificial Sequence
  COP9 signalosome complex subunit 1 (358-365)
cuggccccccacgugagaacccuc

SEQ ID NO: 69570 - RNA, 27 nt, Artificial Sequence
  WAS/WASL-interacting protein family member 2 (294-302)
cuggcccccccuccaccgaccagcgcu

SEQ ID NO: 69571 - RNA, 24 nt, Artificial Sequence
  Ancient ubiquitous protein 1 (300-307)
cuggcccagagagugaaggagguc

SEQ ID NO: 69572 - RNA, 27 nt, Artificial Sequence
  Fatty acid synthase (899-907)
cuggccagagcucucggccuuggggug

SEQ ID NO: 69573 - RNA, 30 nt, Artificial Sequence
  Molybdate-anion transporter (181-190)
cuggccguggucgcuggcguugcagccgag

SEQ ID NO: 69574 - RNA, 54 nt, Artificial Sequence
  Epidermal growth factor receptor (5-22)
cuggccguggucagccucaacaucaccucccuuggccugagaucuuugaaggag

SEQ ID NO: 69575 - RNA, 21 nt, Artificial Sequence
  Serum albumin (484-490)
cugugcgugcuccacgagaag

SEQ ID NO: 69576 - RNA, 69 nt, Artificial Sequence
  Actin, cytoplasmic 2 (73-95)
cugugcuacguggcccucgacuucgagcaggaaauggcuaccgcagccagcuccucuucacuugagaag

SEQ ID NO: 69577 - RNA, 24 nt, Artificial Sequence
  Coiled-coil domain-containing protein 93 (525-532)
cuggacgauaagaaaguguaccuc

SEQ ID NO: 69578 - RNA, 30 nt, Artificial Sequence
  Melanoma inhibitory activity protein 3 (157-166)
cuggacgauaccgccaagaaccucagagug

SEQ ID NO: 69579 - RNA, 24 nt, Artificial Sequence
  Axin-1 (509-516)
cuggacgagcacgugcagagaguc

SEQ ID NO: 69580 - RNA, 24 nt, Artificial Sequence
  Probable ATP-dependent RNA helicase DDX27 (86-93)
cuggacgagaagaucgaaaaagug

SEQ ID NO: 69581 - RNA, 24 nt, Artificial Sequence
  U6 snRNA-associated Sm-like protein LSm8 (17-24)
cuggacgagagccacgaaagagug

SEQ ID NO: 69582 - RNA, 111 nt, Artificial Sequence
  Collagen alpha-1(XX) chain (189-225)
cuggacuuccuccagcuuggcgcccuggcuggguuguuaagcagacugaucugccaaaggcuacagggagguuccccccggcagggcccugcagccgcgccagcucucgau

SEQ ID NO: 69583 - RNA, 24 nt, Artificial Sequence
  Prelamin-A/C (55-62)
cuggacuuccagaagaacaucuac

SEQ ID NO: 69584 - RNA, 30 nt, Artificial Sequence
  ATP-binding cassette sub-family A member 13 (447-456)
cuggacggcgcccucagaaacgcuaucgca

SEQ ID NO: 69585 - RNA, 21 nt, Artificial Sequence
  Mitochondrial dicarboxylate carrier (145-151)
cuggacggccucuacagagug

SEQ ID NO: 69586 - RNA, 21 nt, Artificial Sequence
  Heat shock protein HSP 90-beta (497-503)
cuggacaagaaaguggagaag

SEQ ID NO: 69587 - RNA, 24 nt, Artificial Sequence
  RHO/RAC effector protein (1024-1031)
cuggacaagaacgaucacagccuc

SEQ ID NO: 69588 - RNA, 21 nt, Artificial Sequence
  Small subunit processome component 20 homolog (301-307)
cuggaccuccacaccaaggug

SEQ ID NO: 69589 - RNA, 24 nt, Artificial Sequence
  Exportin-1 (715-722)
cuggacaugcucaacguguacaag

SEQ ID NO: 69590 - RNA, 27 nt, Artificial Sequence
  Mediator of RNA polymerase II transcription subunit 12 (1430-1438)
cuggacaugcucagcgugcuuaucaac

SEQ ID NO: 69591 - RNA, 24 nt, Artificial Sequence
  Serine/threonine-protein kinase N1 (459-466)
cuggacaacgagagacacgaagug

SEQ ID NO: 69592 - RNA, 27 nt, Artificial Sequence
  SWI/SNF-related matrix-associated actin-dependent regulator of chromatin subfamily A member 5 (921-929)
cuggacaccaagaucggcagauacaaa

SEQ ID NO: 69593 - RNA, 27 nt, Artificial Sequence
  Serine-protein kinase ATM (1050-1058)
cuggaggccgaccccuacagcaagugg

SEQ ID NO: 69594 - RNA, 39 nt, Artificial Sequence
  Erlin-2 (327-339)
cuggaggacgaaccccucgagaccgccacaaaggaaaac

SEQ ID NO: 69595 - RNA, 30 nt, Artificial Sequence
  Spectrin beta chain, non-erythrocytic 1 (740-749)
cuggaggaagccagccuccuucaccaguuc

SEQ ID NO: 69596 - RNA, 27 nt, Artificial Sequence
  Structural maintenance of chromosomes protein 1A (367-375)
cuggaggaaaaccaggugaagaaauac

SEQ ID NO: 69597 - RNA, 39 nt, Artificial Sequence
  Moesin (16-28)
cuggaguucgccauccagcccaacaccacaggcaagcaa

SEQ ID NO: 69598 - RNA, 42 nt, Artificial Sequence
  Moesin (16-29)
cuggaguucgccauccagcccaacaccacaggcaagcaacuc

SEQ ID NO: 69599 - RNA, 30 nt, Artificial Sequence; identical to SEQ ID NO: 45372
  Synemin (898-907)

SEQ ID NO: 69600 - RNA, 21 nt, Artificial Sequence
  Melanoma-associated antigen 4 (288-294)
cuggagcacguggucagaguu

SEQ ID NO: 69601 - RNA, 27 nt, Artificial Sequence
  Keratin, type II cytoskeletal 1 (477-485)
cuggagaucgccaccuacagaacacuc

SEQ ID NO: 69602 - RNA, 27 nt, Artificial Sequence
  Integrator complex subunit 11 (341-349)
cuggagauggaaggcagacaggugcuc

SEQ ID NO: 69603 - RNA, 27 nt, Artificial Sequence
  Voltage-dependent calcium channel subunit alpha-2/delta-1 (566-574)
cuggagaacgacaucaagguggaaauu

SEQ ID NO: 69604 - RNA, 27 nt, Artificial Sequence
  Histone acetyltransferase type B catalytic subunit (44-52)
cuggagaacgacaucagaaccuucuuu

SEQ ID NO: 69605 - RNA, 51 nt, Artificial Sequence
  Thioredoxin domain-containing protein 15 (185-201)
cuggagaacuucacccucaagauccuuaauaugagccaggaccugauggau

SEQ ID NO: 69606 - RNA, 36 nt, Artificial Sequence
  HLA class I histocompatibility antigen, A-2 alpha chain (171-182)
cuggagaacggcaaggaaacccuccagagaacagac

SEQ ID NO: 69607 - RNA, 27 nt, Artificial Sequence
  V-type proton ATPase subunit H (318-326)
cuggagaaccucgaacagcaaaaguac

SEQ ID NO: 69608 - RNA, 45 nt, Artificial Sequence
  Tubulin beta-6 chain (68-82)
cuggagcccggcaccauggacagcgugagauccgggccuuucgga

SEQ ID NO: 69609 - RNA, 27 nt, Artificial Sequence
  DNA repair protein RAD51 homolog 3 (91-99)
cuggagcaggaacacacccaaggcuuc

SEQ ID NO: 69610 - RNA, 27 nt, Artificial Sequence
  Laminin subunit gamma-1 (1296-1304)
cuggagcagcucaucgaccaaaagcuu

SEQ ID NO: 69611 - RNA, 24 nt, Artificial Sequence
  Serine/arginine-rich splicing factor 3 (26-33)
cuggagagagccuucggcuacuau

SEQ ID NO: 69612 - RNA, 24 nt, Artificial Sequence
  Melanoma-associated antigen 4 (137-144)
cuggagagagugaucaagaacuac

SEQ ID NO: 69613 - RNA, 42 nt, Artificial Sequence
  Kin of IRRE-like protein 1 (338-351)
cuggagagauacaccguggaaaggacaaacagcggcuccggg

SEQ ID NO: 69614 - RNA, 21 nt, Artificial Sequence
  Cyclic AMP-dependent transcription factor ATF-4 (38-44)
cuggagguggccaagcacuuc

SEQ ID NO: 69615 - RNA, 66 nt, Artificial Sequence
  Calpain-2 catalytic subunit (459-480)
cuguucgcccagcucgcuggcgaggacgcagaaaucagcgccuuugagcuucaaaccauucugaga

SEQ ID NO: 69616 - RNA, 27 nt, Artificial Sequence
  Vacuolar protein sorting-associated protein 8 homolog (853-861)
cuguucgaccaggugcucgaguuucuu

SEQ ID NO: 69617 - RNA, 30 nt, Artificial Sequence
  Titin (9698-9707)
cuguucuuugugagcgagccccaguccauc

SEQ ID NO: 69618 - RNA, 24 nt, Artificial Sequence
  Protein MCM10 homolog (334-341)
cuguucggcgaggugcacaaggcc

SEQ ID NO: 69619 - RNA, 24 nt, Artificial Sequence
  Guanine nucleotide-binding protein subunit beta-5 (321-328)
cuguucggccacgagaacagagug

SEQ ID NO: 69620 - RNA, 30 nt, Artificial Sequence
  Cullin-7 (1270-1279)
cuguucggccccagagccgcuuuucuccuu

SEQ ID NO: 69621 - RNA, 30 nt, Artificial Sequence
  HLA class II histocompatibility antigen, DP alpha 1 chain (167-176)
cuguuccuccccagaaccgacuacagcuuu

SEQ ID NO: 69622 - RNA, 33 nt, Artificial Sequence
  ER membrane protein complex subunit 1 (430-440)
cuguuccuccagcaacuugccggcaaggugguc

SEQ ID NO: 69623 - RNA, 24 nt, Artificial Sequence
  Asparagine synthetase (glutamine-hydrolyzing) (155-162)
cuguucaacaaugccgugaagaaa

SEQ ID NO: 69624 - RNA, 27 nt, Artificial Sequence
  Chloride transport protein 6 (104-112)
cuguucacccagcucaaguuuggcgug

SEQ ID NO: 69625 - RNA, 30 nt, Artificial Sequence
  Cytochrome c oxidase subunit 1 (347-356)
cuguucaccgugggcgggcucacaggaauc

SEQ ID NO: 69626 - RNA, 30 nt, Artificial Sequence
  Protein-glutamine gamma-glutamyltransferase 5 (627-636)
cugggcgccgcuguggucaaccagccccuc

SEQ ID NO: 69627 - RNA, 33 nt, Artificial Sequence
  Elastin (48-58)
cugggcgcccucgggggaggugcucuuggcccc

SEQ ID NO: 69628 - RNA, 21 nt, Artificial Sequence
  Proteasome subunit beta type-4 (122-128)
cugggcgacgggcacagcuac

SEQ ID NO: 69629 - RNA, 27 nt, Artificial Sequence
  Mitogen-activated protein kinase 4 (26-34)
cugggcuucggggugaacggacucguc

SEQ ID NO: 69630 - RNA, 21 nt, Artificial Sequence
  Lipopolysaccharide-responsive and beige-like anchor protein (138-144)
cugggcaagaucgagaaagug

SEQ ID NO: 69631 - RNA, 21 nt, Artificial Sequence
  EH domain-containing protein 4 (484-490)
cugggcaagaucuggaaacuc

SEQ ID NO: 69632 - RNA, 27 nt, Artificial Sequence
  Probable E3 ubiquitin-protein ligase HECTD4 (712-720)
cugggcaaguacgccgagagcauccuc

SEQ ID NO: 69633 - RNA, 60 nt, Artificial Sequence
  14-3-3 protein beta/alpha (170-189)
cugggccucgcccuuaacuucagcguguuuuacuaugagauccugaauucccccgaaaag

SEQ ID NO: 69634 - RNA, 102 nt, Artificial Sequence
  Heat shock protein HSP 90-alpha (510-543)
cugggccucgggaucgacgaggaugaccccaccgccgaugacacaagcgcugcagugacugaagagaugccuccacuugaaggagaugacgauacguccaga

SEQ ID NO: 69635 - RNA, 30 nt, Artificial Sequence
  HLA class II histocompatibility antigen, DQ alpha 1 chain (223-232)
cugggccucagcguggggcuugucggaauc

SEQ ID NO: 69636 - RNA, 27 nt, Artificial Sequence
  Splicing factor 3B subunit 2 (104-112)
cugggccccccuccaccgcucagagug

SEQ ID NO: 69637 - RNA, 30 nt, Artificial Sequence
  Ankyrin repeat domain-containing protein 17 (882-891)
cugggccaggggauccucaccgagacacaa

SEQ ID NO: 69638 - RNA, 33 nt, Artificial Sequence
  Transketolase (38-48)
cugggccaggggcucggagccgcuugcgguaug

SEQ ID NO: 69639 - RNA, 24 nt, Artificial Sequence
  60S ribosomal protein L13a (138-145)
cugggcagacucgcccacgaggug

SEQ ID NO: 69640 - RNA, 72 nt, Artificial Sequence
  Filamin-B (1896-1919)
cugggcagcgccgcugacuuccuccuugauaucuccgagaccgaccugucuucauugacagcaaguauuaag

SEQ ID NO: 69641 - RNA, 21 nt, Artificial Sequence
  YY1-associated protein 1 (323-329)
cugggcagcgagaccagauac

SEQ ID NO: 69642 - RNA, 30 nt, Artificial Sequence
  Cadherin-2 (351-360)
cugcacgccggcaccaugcucacaacuuuc

SEQ ID NO: 69643 - RNA, 24 nt, Artificial Sequence
  Mortality factor 4-like protein 1 (291-298)
cugcacgacuuccucaaguaccuu

SEQ ID NO: 69644 - RNA, 30 nt, Artificial Sequence
  Cyclin-G-associated kinase (18-27)
cugcacagcgaggugggcgccgggcccgcu

SEQ ID NO: 69645 - RNA, 96 nt, Artificial Sequence
  Glia-derived nexin (345-376)
cugcacgugagccauauccuccagaaggccaaaauugaggucuccgaagacggcaccaaggcuucugcagccacaacugcgauacuuaucgcuaga

SEQ ID NO: 69646 - RNA, 102 nt, Artificial Sequence
  Glia-derived nexin (345-378)
cugcacgugagccauauccuccagaaggccaaaauugaggucuccgaagacggcaccaaggcuucugcagccacaacugcgauacuuaucgcuagaucaagu

SEQ ID NO: 69647 - RNA, 30 nt, Artificial Sequence
  Cyclin-dependent kinase 1 (135-144)
cugaucgacgauaagggcaccauuaaacuc

SEQ ID NO: 69648 - RNA, 27 nt, Artificial Sequence
  CCR4-NOT transcription complex subunit 3 (77-85)
cugaucgacaacagaaagcucauugag

SEQ ID NO: 69649 - RNA, 27 nt, Artificial Sequence
  Eukaryotic translation initiation factor 3 subunit L (66-74)
cugaucgaccagaagguguacgagcuc

SEQ ID NO: 69650 - RNA, 24 nt, Artificial Sequence
  Dystonin (1766-1773)
cugaucgacagagagaccauguuc

SEQ ID NO: 69651 - RNA, 30 nt, Artificial Sequence
  Elongation factor 2 (102-111)
cugaucgacagccccggccacguggauuuc

SEQ ID NO: 69652 - RNA, 27 nt, Artificial Sequence
  Ubiquitin-like domain-containing CTD phosphatase 1 (226-234)
cugaucgacgugaagccccucggcguc

SEQ ID NO: 69653 - RNA, 24 nt, Artificial Sequence
  Programmed cell death protein 5 (92-99)
cugaucgagauucucaagaaagug

SEQ ID NO: 69654 - RNA, 24 nt, Artificial Sequence
  Nuclear pore complex protein Nup205 (249-256)
cugaucggccaccucgagagagug

SEQ ID NO: 69655 - RNA, 72 nt, Artificial Sequence
  Vimentin (443-466)
cugaucaagaccguggagacaagagacggccaggucauuaacgaaacuagccaacaccaugaugaccucgag

SEQ ID NO: 69656 - RNA, 30 nt, Artificial Sequence; identical to SEQ ID NO: 45429
  Syndetin (107-116)

SEQ ID NO: 69657 - RNA, 27 nt, Artificial Sequence
  Small subunit processome component 20 homolog (1298-1306)
cugauccucccccacgugccugccauu

SEQ ID NO: 69658 - RNA, 27 nt, Artificial Sequence
  Patatin-like phospholipase domain-containing protein 2 (154-162)
cugauccccccuagccuccagggcgug

SEQ ID NO: 69659 - RNA, 27 nt, Artificial Sequence
  Histone deacetylase 6 (119-127)
cugauccaggagggccuccuugacaga

SEQ ID NO: 69660 - RNA, 27 nt, Artificial Sequence
  Membrane-bound transcription factor site-2 protease (165-173)
cugaucagcggcgugguccacgagauu

SEQ ID NO: 69661 - RNA, 24 nt, Artificial Sequence
  Asparagine synthetase (glutamine-hydrolyzing) (264-271)
cugaucagcaaguacauuagaaaa

SEQ ID NO: 69662 - RNA, 33 nt, Artificial Sequence
  Histone H4 (19-29)
cugaucuacgaggaaaccagaggcgugcucaag

SEQ ID NO: 69663 - RNA, 33 nt, Artificial Sequence
  Endoplasmic reticulum-Golgi intermediate compartment protein 3 (328-338)
cugaucuaccacagcgccagagcuauucagaag

SEQ ID NO: 69664 - RNA, 30 nt, Artificial Sequence
  Zinc finger protein 638 (6-15)
cugaaggcccucaacagcaauuccaucuac

SEQ ID NO: 69665 - RNA, 24 nt, Artificial Sequence
  Protein FAM171B (21-28)
cugaaggccagacucgugcccgcu

SEQ ID NO: 69666 - RNA, 33 nt, Artificial Sequence
  E3 ubiquitin-protein ligase UHRF1 (701-711)
cugaaggacagacccgccagcggcuccccuuuc

SEQ ID NO: 69667 - RNA, 21 nt, Artificial Sequence
  Putative RNA exonuclease NEF-sp (343-349)
cugaaguuccucgccaaagug

SEQ ID NO: 69668 - RNA, 39 nt, Artificial Sequence
  Triosephosphate isomerase (155-167)
cugaagcccgaguucguggacaucauuaacgccaaacag

SEQ ID NO: 69669 - RNA, 42 nt, Artificial Sequence
  Transmembrane protein 181 (194-207)
cugaagcccauccagauucucagcaacccucuuuccaccuac

SEQ ID NO: 69670 - RNA, 24 nt, Artificial Sequence
  Clathrin light chain A (223-230)
cugaagcaggccccccucgugcac

SEQ ID NO: 69671 - RNA, 24 nt, Artificial Sequence
  Eukaryotic translation initiation factor 4 gamma 1 (786-793)
cugaaggugcccaccacagagaaa

SEQ ID NO: 69672 - RNA, 30 nt, Artificial Sequence
  T-complex protein 1 subunit eta (12-21)
cugcucgccgcugaguuccuuaagcaggug

SEQ ID NO: 69673 - RNA, 33 nt, Artificial Sequence
  E3 ubiquitin-protein ligase UBR4 (195-205)
cugcucgccgcuggcagccagcuugacaccgug

SEQ ID NO: 69674 - RNA, 27 nt, Artificial Sequence
  Torsin-1B (16-24)
cugcucgccgcuagaguggucgcagcc

SEQ ID NO: 69675 - RNA, 27 nt, Artificial Sequence
  Vacuolar protein sorting-associated protein 18 homolog (338-346)
cugcucgccgacagaguggaggcuguc

SEQ ID NO: 69676 - RNA, 27 nt, Artificial Sequence
  Protein zyg-11 homolog B (139-147)
cugcucgccgacgugacccaccuucug

SEQ ID NO: 69677 - RNA, 27 nt, Artificial Sequence
  Tumor suppressor candidate 3 (48-56)
cugcucgccgagaagguggaacagcuu

SEQ ID NO: 69678 - RNA, 36 nt, Artificial Sequence
  Sulfhydryl oxidase 1 (651-662)
cugcucgccgagagcagagcugaaaagaacaggcuu

SEQ ID NO: 69679 - RNA, 33 nt, Artificial Sequence
  Poly (ADP-ribose) polymerase 10 (465-475)
cugcucgccggccuuggggacguggcucuguug

SEQ ID NO: 69680 - RNA, 27 nt, Artificial Sequence
  General transcription factor IIH subunit 3 (91-99)
cugcucgccggcagccuugcuaaggca

SEQ ID NO: 69681 - RNA, 27 nt, Artificial Sequence
  E3 ubiquitin-protein ligase MARCH6 (678-686)
cugcucgccggcguggucccccuucug

SEQ ID NO: 69682 - RNA, 30 nt, Artificial Sequence
  DNA-directed RNA polymerases I, II, and III subunit RPABC5 (49-58)
cugcucgcccacguggaccuuaucgagaag

SEQ ID NO: 69683 - RNA, 75 nt, Artificial Sequence
  RWD domain-containing protein 1 (86-110)
cugcucgcccuucaggcugaggaaaaccugggcauggugaugaucuucaccuuggucacagcaguucaagagaag

SEQ ID NO: 69684 - RNA, 27 nt, Artificial Sequence
  N-terminal kinase-like protein (58-66)
cugcucgcccccaagcuuaacgaggcu

SEQ ID NO: 69685 - RNA, 27 nt, Artificial Sequence
  Actin-binding protein anillin (610-618)
cugcucgccccccuugcucagaccgug

SEQ ID NO: 69686 - RNA, 27 nt, Artificial Sequence
  Transmembrane and coiled-coil domain-containing protein 3 (411-419)
cugcucgcccccgugcuuuggagagcu

SEQ ID NO: 69687 - RNA, 24 nt, Artificial Sequence
  Receptor-interacting serine/threonine-protein kinase 4 (150-157)
cugcucgacgcccacuaccaugug

SEQ ID NO: 69688 - RNA, 27 nt, Artificial Sequence
  Brefeldin A-inhibited guanine nucleotide-exchange protein 1 (1477-1485)
cugcucgacgauaucuucgcccagcuu

SEQ ID NO: 69689 - RNA, 33 nt, Artificial Sequence
  ETS translocation variant 1 (241-251)
cugcucgacgaucccagcaacucccacuucauc

SEQ ID NO: 69690 - RNA, 30 nt, Artificial Sequence
  Contactin-associated protein-like 4 (266-275)
cugcucgacgaucagcacuggcauagcgug

SEQ ID NO: 69691 - RNA, 27 nt, Artificial Sequence
  Protein FAM179B (402-410)
cugcucgacgauagcaacuucaaggug

SEQ ID NO: 69692 - RNA, 24 nt, Artificial Sequence
  von Willebrand factor A domain-containing protein 8 (512-519)
cugcucgacggcauccacagagug

SEQ ID NO: 69693 - RNA, 27 nt, Artificial Sequence
  Leucine-rich repeat-containing protein 40 (571-579)
cugcucgacggcaaccccuucagagug

SEQ ID NO: 69694 - RNA, 24 nt, Artificial Sequence
  Uridine-cytidine kinase-like 1 (454-461)
cugcucgaccacgaugugcccgag

SEQ ID NO: 69695 - RNA, 27 nt, Artificial Sequence
  Armadillo repeat protein deleted in velo-cardio-facial syndrome (408-416)
cugcucgaccaccccagagccgaggug

SEQ ID NO: 69696 - RNA, 27 nt, Artificial Sequence
  Integrator complex subunit 8 (617-625)
cugcucgacauccacacccaugaggcc

SEQ ID NO: 69697 - RNA, 27 nt, Artificial Sequence
  RNA-binding protein 20 (68-76)
cugcucgacaagaaccccuucagcgug

SEQ ID NO: 69698 - RNA, 24 nt, Artificial Sequence
  Small subunit processome component 20 homolog (300-307)
cugcucgaccuucacaccaaggug

SEQ ID NO: 69699 - RNA, 27 nt, Artificial Sequence
  AP-1 complex subunit beta-1 (395-403)
cugcucgaccuuauccagaccaaggug

SEQ ID NO: 69700 - RNA, 27 nt, Artificial Sequence
  ERI1 exoribonuclease 3 (155-163)
cugcucgaccccaacgugaagagcauc

SEQ ID NO: 69701 - RNA, 30 nt, Artificial Sequence
  DDB1- and CUL4-associated factor 16 (80-89)
cugcucgaccccagcaccccugugcacauc

SEQ ID NO: 69702 - RNA, 24 nt, Artificial Sequence
  Coiled-coil domain-containing protein 180 (707-714)
cugcucgaccagcuuagacaacag

SEQ ID NO: 69703 - RNA, 21 nt, Artificial Sequence
  Protein Bop (113-119)
cugcucgacagauuccuugcc

SEQ ID NO: 69704 - RNA, 24 nt, Artificial Sequence
  Nuclear pore complex protein Nup205 (319-326)
cugcucgacagaaucgugagcguc

SEQ ID NO: 69705 - RNA, 30 nt, Artificial Sequence
  Plexin-B3 (450-459)
cugcucgacagcuccggcucucaccuuuac

SEQ ID NO: 69706 - RNA, 27 nt, Artificial Sequence
  Protein PML (195-203)
cugcucgacagcucccacucugagcuu

SEQ ID NO: 69707 - RNA, 33 nt, Artificial Sequence
  Asparagine synthetase (glutamine-hydrolyzing) (42-52)
cugcucgacaccgccaacaagaaaguguuccuu

SEQ ID NO: 69708 - RNA, 24 nt, Artificial Sequence
  Myosin-10 (265-272)
cugcucgagaagagcagagccgug

SEQ ID NO: 69709 - RNA, 30 nt, Artificial Sequence
  Serine/threonine-protein kinase Kist (127-136)
cugcucgagauguucagcggcaugaagcuu

SEQ ID NO: 69710 - RNA, 30 nt, Artificial Sequence
  Serine/threonine-protein kinase MRCK gamma (979-988)
cugcucuucgacgcccccgaucuuagacug

SEQ ID NO: 69711 - RNA, 27 nt, Artificial Sequence
  Cartilage-associated protein (322-330)
cugcucuucgaccagaacgauaaggug

SEQ ID NO: 69712 - RNA, 39 nt, Artificial Sequence
  Protein wntless homolog (297-309)
cugcucuucggcgacaucagacaggggauuuuuuacgcc

SEQ ID NO: 69713 - RNA, 27 nt, Artificial Sequence
  Cytoplasmic dynein 2 heavy chain 1 (138-146)
cugcucuucggcgaccuucugagagug

SEQ ID NO: 69714 - RNA, 30 nt, Artificial Sequence
  Protein YIF1B (224-233)
cugcucuucggcaagaucggguacuaucuu

SEQ ID NO: 69715 - RNA, 27 nt, Artificial Sequence
  Probable palmitoyltransferase ZDHHC24 (214-222)
cugcucuuccacggcaugcuucuguug

SEQ ID NO: 69716 - RNA, 27 nt, Artificial Sequence
  Kelch-like protein 5 (518-526)
cugcucggcgacaagcuuuacgccgug

SEQ ID NO: 69717 - RNA, 27 nt, Artificial Sequence
  E3 ubiquitin-protein ligase RNF213 (957-965)
cugcucggcgacauggaguggagacuu

SEQ ID NO: 69718 - RNA, 24 nt, Artificial Sequence
  Receptor-type tyrosine-protein phosphatase T (1084-1091)
cugcucggcuucgugagacagguc

SEQ ID NO: 69719 - RNA, 33 nt, Artificial Sequence
  Neurosecretory protein VGF (286-296)
cugcucggcgggagcgaggccggagaaagacuu

SEQ ID NO: 69720 - RNA, 24 nt, Artificial Sequence
  MAU2 chromatid cohesion factor homolog (357-364)
cugcucggccacaucuucuacgug

SEQ ID NO: 69721 - RNA, 24 nt, Artificial Sequence
  Polypeptide N-acetylgalactosaminyltransferase 2 (186-193)
cugcucggcaagaucgagaaagug

SEQ ID NO: 69722 - RNA, 24 nt, Artificial Sequence
  Spectrin alpha chain, non-erythrocytic 1 (418-425)
cugcucggcagcgcccacgaggug

SEQ ID NO: 69723 - RNA, 30 nt, Artificial Sequence
  Zinc finger X-linked protein ZXDA (257-266)
cugcucggcagcgggcccggagugguccuu

SEQ ID NO: 69724 - RNA, 30 nt, Artificial Sequence
  CUB and sushi domain-containing protein 1 (2833-2842)
cugcucggcagcuccgcccuuaccugcaug

SEQ ID NO: 69725 - RNA, 27 nt, Artificial Sequence
  Protein virilizer homolog (786-794)
cugcucggcacccuucacaaccuguac

SEQ ID NO: 69726 - RNA, 27 nt, Artificial Sequence
  Zinc transporter ZIP1 (215-223)
cugcuccacaagggcauccuugccgug

SEQ ID NO: 69727 - RNA, 33 nt, Artificial Sequence
  Catenin beta-1 (263-273)
cugcuccaccaggagggcgccaagauggcugug

SEQ ID NO: 69728 - RNA, 27 nt, Artificial Sequence
  Actin-binding protein anillin (773-781)
cugcucaucgacgagcuuaacaagcug

SEQ ID NO: 69729 - RNA, 48 nt, Artificial Sequence
  Tastin (465-480)
cugcucaucggccuugccguggggggagguggcggggaggacagcacc

SEQ ID NO: 69730 - RNA, 27 nt, Artificial Sequence
  Mitochondrial dynamics protein MID49 (418-426)
cugcucaucggcagccuugagcaggcc

SEQ ID NO: 69731 - RNA, 75 nt, Artificial Sequence
  Vimentin (276-300)
cugcucaucaagaccguggagacaagagacggccaggucauuaacgaaacuagccaacaccaugaugaccuugag

SEQ ID NO: 69732 - RNA, 27 nt, Artificial Sequence
  Histone deacetylase 9 (93-101)
cugcucauccagcaacagcagcagauu

SEQ ID NO: 69733 - RNA, 30 nt, Artificial Sequence
  Dolichyl-diphosphooligosaccharide-proteinosyltransferase 48 kDa subunit (180-189)
cugcucaaggcccccaccaucgugggcaaa

SEQ ID NO: 69734 - RNA, 27 nt, Artificial Sequence
  Protein FAM171B (20-28)
cugcucaaggccagacuugugcccgcu

SEQ ID NO: 69735 - RNA, 24 nt, Artificial Sequence
  Melanoma-associated antigen 10 (311-318)
cugcucaaguuccuugccaaagug

SEQ ID NO: 69736 - RNA, 27 nt, Artificial Sequence
  Protein TANC1 (360-368)
cugcucaagccccuucuguucgaggug

SEQ ID NO: 69737 - RNA, 24 nt, Artificial Sequence
  Asparagine synthetase (glutamine-hydrolyzing) (187-194)
cugcucaagcagcuuaaagaggcc

SEQ ID NO: 69738 - RNA, 33 nt, Artificial Sequence; identical to SEQ ID NO: 45511
  Transmembrane protein 132B (372-382)

SEQ ID NO: 69739 - RNA, 39 nt, Artificial Sequence
  BAH and coiled-coil domain-containing protein 1 (636-648)
cugcucaaguacagcucccaggcccuuguggucggccaa

SEQ ID NO: 69740 - RNA, 30 nt, Artificial Sequence
  Procollagen-lysine,2-oxoglutarate 5-dioxygenase 3 (319-328)
cugcuccuugacuaccccccugauagagug

SEQ ID NO: 69741 - RNA, 36 nt, Artificial Sequence
  Procollagen-lysine,2-oxoglutarate 5-dioxygenase 3 (319-330)
cugcuccuugacuaccccccugauagagugacccug

SEQ ID NO: 69742 - RNA, 24 nt, Artificial Sequence
  Mediator of RNA polymerase II transcription subunit 12 (988-995)
cugcuccuugaggaccugaucaga

SEQ ID NO: 69743 - RNA, 27 nt, Artificial Sequence
  Mediator of RNA polymerase II transcription subunit 12 (988-996)
cugcuccuugaggaccugaucagaugc

SEQ ID NO: 69744 - RNA, 27 nt, Artificial Sequence
  Myosin phosphatase Rho-interacting protein (997-1005)
cugcuccuugagaagacccaggaacug

SEQ ID NO: 69745 - RNA, 63 nt, Artificial Sequence
  Fatty acid synthase (81-101)
cugcuccuugaggugaccuacgaagccaucgucgacggcgggauuaaccccgauagccugaga

SEQ ID NO: 69746 - RNA, 45 nt, Artificial Sequence
  Ephrin type-B receptor 3 (28-42)
cugcuccuucugcccgccggcugcagagcuuuggaggaaaccuua

SEQ ID NO: 69747 - RNA, 27 nt, Artificial Sequence
  TBC1 domain family member 9 (215-223)
cugcuccuucccgacgugaucaagguc

SEQ ID NO: 69748 - RNA, 27 nt, Artificial Sequence
  Lysosomal thioesterase PPT2 (16-24)
cugcuccuucccuuccugccuuuguua

SEQ ID NO: 69749 - RNA, 27 nt, Artificial Sequence
  Tartrate-resistant acid phosphatase type 5 (13-21)
cugcuccuucccagccuggccgacggc

SEQ ID NO: 69750 - RNA, 27 nt, Artificial Sequence
  Cathepsin K (7-15)
cugcuccuucccguggucagcuucgcc

SEQ ID NO: 69751 - RNA, 27 nt, Artificial Sequence
  4F2 cell-surface antigen heavy chain (521-529)
cugcuccuuagauuccccuacgccgcu

SEQ ID NO: 69752 - RNA, 33 nt, Artificial Sequence
  Glypican-6 (15-25)
cugcuccuuagccugcccgccggcgcugacgug

SEQ ID NO: 69753 - RNA, 33 nt, Artificial Sequence
  Tyrosinase (514-524)
cugcucauggagaaggaagacuaccacagccuu

SEQ ID NO: 69754 - RNA, 27 nt, Artificial Sequence
  Glutamine-tRNA ligase (137-145)
cugcucaugggcgaggccagagcugug

SEQ ID NO: 69755 - RNA, 27 nt, Artificial Sequence
  Nucleolar protein 11 (405-413)
cugcucaacgccauccuucacagcgcu

SEQ ID NO: 69756 - RNA, 33 nt, Artificial Sequence
  Eukaryotic translation initiation factor 4 gamma 1 (363-373)
cugcucaacggcgcccccagcccuccagcugug

SEQ ID NO: 69757 - RNA, 27 nt, Artificial Sequence
  Plexin-B3 (1376-1384)
cugcucaacagcaagcuuuuccuguug

SEQ ID NO: 69758 - RNA, 27 nt, Artificial Sequence
  E3 ubiquitin-protein ligase CBL (87-95)
cugcuccccgacaccuaccagcaccuu

SEQ ID NO: 69759 - RNA, 27 nt, Artificial Sequence
  F-box only protein 46 (301-309)
cugcuccccgagcacgugcuugucaag

SEQ ID NO: 69760 - RNA, 33 nt, Artificial Sequence
  Fibronectin isoform 6 (1328-1338)
cugcuccccggcaccgaguacguggucagcguu

SEQ ID NO: 69761 - RNA, 27 nt, Artificial Sequence
  Fibronectin type III domain-containing protein 3B (282-290)
cugcuccccggcaccguguacagauuc

SEQ ID NO: 69762 - RNA, 27 nt, Artificial Sequence
  Transportin-2 (391-399)
cugcucccccaccuucugccuuuguua

SEQ ID NO: 69763 - RNA, 27 nt, Artificial Sequence
  Atlastin-3 (264-272)
cugcucccccacccuggccuucaggug

SEQ ID NO: 69764 - RNA, 27 nt, Artificial Sequence
  Probable E3 SUMO-protein ligase RNF212 (145-153)
cugcuccccccucacagcuccgcccca

SEQ ID NO: 69765 - RNA, 27 nt, Artificial Sequence
  Matrix metalloproteinase-17 (588-596)
cugcuccccccucuuagcccaggcgcc

SEQ ID NO: 69766 - RNA, 27 nt, Artificial Sequence
  Astrotactin-2 (41-49)
cugcuccccccuccaccgcuucuggcc

SEQ ID NO: 69767 - RNA, 27 nt, Artificial Sequence
  Serine/threonine-protein kinase 32A (347-355)
cugcuccaggagcaccuugacagcgug

SEQ ID NO: 69768 - RNA, 42 nt, Artificial Sequence
  Adhesion G-protein coupled receptor F3 (210-223)
cugcuccagcccggcacccaagugagcgucacauccucucac

SEQ ID NO: 69769 - RNA, 30 nt, Artificial Sequence
  Interleukin-24 (91-100)
cugcuccagcaagaggugcuucagaacguc

SEQ ID NO: 69770 - RNA, 27 nt, Artificial Sequence
  Oxysterol-binding protein-related protein 10 (231-239)
cugcuccagcaaagcgugcaccaggcc

SEQ ID NO: 69771 - RNA, 27 nt, Artificial Sequence
  Nodal modulator 3 (688-696)
cugcucagagacggcgagaacuacgug

SEQ ID NO: 69772 - RNA, 21 nt, Artificial Sequence
  Serine/threonine-protein phosphatase PP1-beta catalytic subunit (71-77)
cugcucagacuuuucgaguac

SEQ ID NO: 69773 - RNA, 27 nt, Artificial Sequence
  Sorting nexin-10 (27-35)
cugcucagcgacuccucucuucaccug

SEQ ID NO: 69774 - RNA, 27 nt, Artificial Sequence
  Brefeldin A-inhibited guanine nucleotide-exchange protein 2 (1424-1432)
cugcucagcgacguguucgcccagcuu

SEQ ID NO: 69775 - RNA, 27 nt, Artificial Sequence
  BTB/POZ domain-containing protein 1 (67-75)
cugcucagcgacgugagauucguccuu

SEQ ID NO: 69776 - RNA, 27 nt, Artificial Sequence
  Spermatogenesis-associated protein 20 (129-137)
cugcucagcgaggacuucguguccguc

SEQ ID NO: 69777 - RNA, 27 nt, Artificial Sequence
  Mediator of RNA polymerase II transcription subunit 13 (188-196)
cugcucagcgaggaacacaucacccuu

SEQ ID NO: 69778 - RNA, 27 nt, Artificial Sequence
  Synemin (707-715)
cugcucagcaaggacaucaaagaggug

SEQ ID NO: 69779 - RNA, 36 nt, Artificial Sequence
  Plexin-B3 (33-44)
cugcucagccccccuccacuuccgcugaccggcgcc

SEQ ID NO: 69780 - RNA, 27 nt, Artificial Sequence
  Nuclear pore complex protein Nup88 (115-123)
cugcucagccccacccagcaccaugug

SEQ ID NO: 69781 - RNA, 27 nt, Artificial Sequence
  Fanconi anemia group D2 protein (1110-1118)
cugcucagccaguccgugcacuaccuu

SEQ ID NO: 69782 - RNA, 24 nt, Artificial Sequence
  Regulatory-associated protein of mTOR (224-231)
cugcucagccaggugcacagacuu

SEQ ID NO: 69783 - RNA, 30 nt, Artificial Sequence
  Muskelin (78-87)
cugcucagcuccggccuuaagaacgacuac

SEQ ID NO: 69784 - RNA, 24 nt, Artificial Sequence
  Ras GTPase-activating-like protein IQGAP2 (416-423)
cugcucagcgugaagcuugagguc

SEQ ID NO: 69785 - RNA, 27 nt, Artificial Sequence
  Mediator of RNA polymerase II transcription subunit 13 (1410-1418)
cugcucaccgacggcaucaugagagug

SEQ ID NO: 69786 - RNA, 27 nt, Artificial Sequence
  T-complex protein 1 subunit zeta-2 (471-479)
cugcucguggacgagaucaugagagcc

SEQ ID NO: 69787 - RNA, 33 nt, Artificial Sequence
  Nuclear factor of activated T-cells, cytoplasmic 2 (115-125)
cugcucguggagcagcccccucuugccggcguc

SEQ ID NO: 69788 - RNA, 33 nt, Artificial Sequence
  Ankyrin repeat and KH domain-containing protein 1 (1008-1018)
cugcucgugcaggagcccgacggccuuaugguc

SEQ ID NO: 69789 - RNA, 27 nt, Artificial Sequence
  Structure-specific endonuclease subunit SLX1 (242-250)
cugcucuggggcgaccuuaucuggcug

SEQ ID NO: 69790 - RNA, 27 nt, Artificial Sequence
  Interleukin-24 (41-49)
cugcucuggagccagguguccggcgcc

SEQ ID NO: 69791 - RNA, 33 nt, Artificial Sequence
  Interleukin-24 (41-51)
cugcucuggagccagguguccggcgcccaaggg

SEQ ID NO: 69792 - RNA, 27 nt, Artificial Sequence
  Glutamate receptor ionotropic, kainate 3 (325-333)
cugcucuacgacgccgugcacaucguc

SEQ ID NO: 69793 - RNA, 33 nt, Artificial Sequence
  AT-rich interactive domain-containing protein 1A (1336-1346)
cugcucuacgacgauaacagcaucaugaccuuc

SEQ ID NO: 69794 - RNA, 30 nt, Artificial Sequence
  Intron-binding protein aquarius (152-161)
cugcucuacgacuuccagcuuaucaacgug

SEQ ID NO: 69795 - RNA, 27 nt, Artificial Sequence
  Nicastrin (501-509)
cugcucuacggcuuccuuaucaaggcc

SEQ ID NO: 69796 - RNA, 30 nt, Artificial Sequence
  Adenosine 3'-phospho 5'-phosphosulfate transporter 1 (251-260)
cugcucuacggccacaccgugacagucguu

SEQ ID NO: 69797 - RNA, 30 nt, Artificial Sequence
  DNA-dependent protein kinase catalytic subunit (421-430)
cugcucuaccuugacaccgugcccgagguc

SEQ ID NO: 69798 - RNA, 27 nt, Artificial Sequence
  Unconventional myosin-Ib (533-541)
cugcucuacagagaccuuagccaggcc

SEQ ID NO: 69799 - RNA, 27 nt, Artificial Sequence
  Nuclear pore complex protein Nup85 (266-274)
cugcucuacagcaaccccaccgugaag

SEQ ID NO: 69800 - RNA, 30 nt, Artificial Sequence
  Microtubule-actin cross-linking factor 1, isoforms 1/2/3/5 (794-803)
cugauggacgagaagcuccuucacaacgug

SEQ ID NO: 69801 - RNA, 30 nt, Artificial Sequence
  Tyrosinase (515-524)
cugauggagaaggaagacuaccacagccuc

SEQ ID NO: 69802 - RNA, 33 nt, Artificial Sequence
  Tyrosinase (515-525)
cugauggagaaggaagacuaccacagccucuau

SEQ ID NO: 69803 - RNA, 24 nt, Artificial Sequence
  Leucine-tRNA ligase, cytoplasmic (211-218)
cugauggaggugacccacgaccuc

SEQ ID NO: 69804 - RNA, 24 nt, Artificial Sequence
  Dynein light chain roadblock-type 1 (52-59)
cugaugcacagcuucauccucaag

SEQ ID NO: 69805 - RNA, 30 nt, Artificial Sequence
  T-complex protein 1 subunit beta (159-168)
cugaugaacaucgccggcaccacacucagc

SEQ ID NO: 69806 - RNA, 24 nt, Artificial Sequence
  Phosphatidylinositol 5-phosphate 4-kinase type-2 beta (66-73)
cugaugcccgacgauuucaaggcc

SEQ ID NO: 69807 - RNA, 27 nt, Artificial Sequence
  Folliculin-interacting protein 1 (804-812)
cugaugagcgaccucucccacgccgug

SEQ ID NO: 69808 - RNA, 27 nt, Artificial Sequence
  Constitutive coactivator of PPAR-gamma-like protein 2 (619-627)
cugauguaccccuauaucuaccacgug

SEQ ID NO: 69809 - RNA, 27 nt, Artificial Sequence
  Sodium channel protein type 5 subunit alpha (1513-1521)
cugaacaaguaccagggcuucaucuuu

SEQ ID NO: 69810 - RNA, 18 nt, Artificial Sequence
  Heterogeneous nuclear ribonucleoprotein K (133-138)
cugaacuaccagcacuau

SEQ ID NO: 69811 - RNA, 24 nt, Artificial Sequence
  Tropomodulin-2 (46-53)
cugcccgccggcuucagacagaag

SEQ ID NO: 69812 - RNA, 21 nt, Artificial Sequence
  Probable ATP-dependent RNA helicase DDX5 (150-156)
cugcccgccaucgugcacauu

SEQ ID NO: 69813 - RNA, 33 nt, Artificial Sequence
  Basement membrane-specific heparan sulfate proteoglycan core protein (1907-1917)
cugcccgccaaggcucagauccacggcgggauu

SEQ ID NO: 69814 - RNA, 24 nt, Artificial Sequence
  UV excision repair protein RAD23 homolog B (278-285)
cugcccgcccuccuucagcaaauc

SEQ ID NO: 69815 - RNA, 27 nt, Artificial Sequence
  Potassium/sodium hyperpolarization-activated cyclic nucleotide-gated channel 3 (671-679)
cugcccgccccuccagcuagaacccuc

SEQ ID NO: 69816 - RNA, 30 nt, Artificial Sequence
  AT-hook-containing transcription factor (393-402)
cugcccgccccuagcggccaggcuccaaug

SEQ ID NO: 69817 - RNA, 30 nt, Artificial Sequence
  Lysosome-associated membraneoprotein 1 (249-258)
cugcccgacgccagagauccugcuuucaag

SEQ ID NO: 69818 - RNA, 48 nt, Artificial Sequence
  Legumain (198-213)
cugcccgacaacaucaauguguacgccaccacagcugcaaacccuaga

SEQ ID NO: 69819 - RNA, 24 nt, Artificial Sequence
  Serine/threonine-protein kinase ULK3 (109-116)
cugcccgagaagguggccagaguc

SEQ ID NO: 69820 - RNA, 24 nt, Artificial Sequence
  Solute carrier family 23 member 2 (603-610)
cugcccuucggcaugaacaucauu

SEQ ID NO: 69821 - RNA, 36 nt, Artificial Sequence
  Retinoic acid receptor RXR-beta (168-179)
cugcccggcgggggaagcgguccuccagaggacgug

SEQ ID NO: 69822 - RNA, 45 nt, Artificial Sequence
  Mucin-19 (5182-5196)
cugcccggcgugagcgccgggcucaccggaacaaucgguuccccu

SEQ ID NO: 69823 - RNA, 27 nt, Artificial Sequence
  (Pyruvate dehydrogenase (acetyl-transferring))-phosphatase 1, mitochondrial (168-176)
cugccccacgagacccuccuugaaauc

SEQ ID NO: 69824 - RNA, 24 nt, Artificial Sequence
  Transportin-1 (395-402)
cugccccacauccucccucuucug

SEQ ID NO: 69825 - RNA, 27 nt, Artificial Sequence
  Phosphatidylcholine translocator ABCB4 (1167-1175)
cugccccacaaguacgagaccagagug

SEQ ID NO: 69826 - RNA, 27 nt, Artificial Sequence
  HMG domain-containing protein 3 (213-221)
cugccccaccucccucagagcgagauc

SEQ ID NO: 69827 - RNA, 27 nt, Artificial Sequence
  Low-density lipoprotein receptor-related protein 2 (704-712)
cugccccacccuuucgccaucaccauu

SEQ ID NO: 69828 - RNA, 24 nt, Artificial Sequence
  Melanophilin (392-399)
cugcccaucuuccucccuagagug

SEQ ID NO: 69829 - RNA, 45 nt, Artificial Sequence
  Collagen alpha-1(I) chain (1013-1027)
cugcccaucauugacguggccccucucgaugucggcgcuccagac

SEQ ID NO: 69830 - RNA, 27 nt, Artificial Sequence
  Coatomer subunit gamma-1 (712-720)
cugcccaaggaggacccuaccgccgug

SEQ ID NO: 69831 - RNA, 27 nt, Artificial Sequence
  Tight junction protein ZO-1 (478-486)
cugcccaagggcgaggaagugaccauc

SEQ ID NO: 69832 - RNA, 24 nt, Artificial Sequence
  40S ribosomal protein S26 (64-71)
cugcccaagcucuacgugaaacuu

SEQ ID NO: 69833 - RNA, 27 nt, Artificial Sequence
  Interferon alpha-inducible protein 27, mitochondrial (28-36)
cugccccucgccagaaucgcuaccgug

SEQ ID NO: 69834 - RNA, 27 nt, Artificial Sequence
  Receptor tyrosine-protein kinase erbB-3 (97-105)
cugccccucccuaaccuuagagugguc

SEQ ID NO: 69835 - RNA, 27 nt, Artificial Sequence
  Ubiquitin domain-containing protein UBFD1 (251-259)
cugcccaugggcagcaucaagaacgug

SEQ ID NO: 69836 - RNA, 27 nt, Artificial Sequence
  Ras-related protein Rab-38 (114-122)
cugcccaacggcaagccugugagcguc

SEQ ID NO: 69837 - RNA, 27 nt, Artificial Sequence
  Transcriptional regulator Kaiso (298-306)
cugcccaaccacaugccuagcuccauc

SEQ ID NO: 69838 - RNA, 27 nt, Artificial Sequence
  Bromodomain-containing protein 4 (958-966)
cugcccccuccaccgcaccccagcgug

SEQ ID NO: 69839 - RNA, 27 nt, Artificial Sequence
  Shootin-1 (302-310)
cugcccccuccaccgcccaacccuauc

SEQ ID NO: 69840 - RNA, 24 nt, Artificial Sequence
  Nicotinamide phosphoribosyltransferase (344-351)
cugcccccuuaccucagagugauc

SEQ ID NO: 69841 - RNA, 27 nt, Artificial Sequence
  Kinase D-interacting substrate of 220 kDa (104-112)
cugcccagagaccagaacaauggccuc

SEQ ID NO: 69842 - RNA, 27 nt, Artificial Sequence
  Cap-specific mRNAucleoside-2'-O-)-methyltransferase 1 (631-639)
cugcccagagacacccuccuuagcgug

SEQ ID NO: 69843 - RNA, 30 nt, Artificial Sequence
  Serine/threonine-protein kinase 32A (171-180)
cugcccagagagacccagaucacaacuaug

SEQ ID NO: 69844 - RNA, 30 nt, Artificial Sequence
  Ubiquitin-associated protein 1 (236-245)
cugcccagaggcgggagcggauccgugcuc

SEQ ID NO: 69845 - RNA, 27 nt, Artificial Sequence
  Intercellular adhesion molecule 1 (16-24)
cugcccagaggcgggagcgugcucguc

SEQ ID NO: 69846 - RNA, 27 nt, Artificial Sequence
  Ropporin-1B (153-161)
cugcccagaaucccuuucagcaccuuu

SEQ ID NO: 69847 - RNA, 27 nt, Artificial Sequence
  LIM domain and actin-binding protein 1 (161-169)
cugcccagacucagcgagaccuccauc

SEQ ID NO: 69848 - RNA, 27 nt, Artificial Sequence
  Apolipoprotein L1 (85-93)
cugcccagaaacgaggccgacgaacuc

SEQ ID NO: 69849 - RNA, 27 nt, Artificial Sequence
  E3 ubiquitin-protein ligase TRIP12 (518-526)
cugcccagaagcuccgccguggucguu

SEQ ID NO: 69850 - RNA, 27 nt, Artificial Sequence
  Periaxin (1315-1323)
cugcccagagugggccucgccgcuccu

SEQ ID NO: 69851 - RNA, 24 nt, Artificial Sequence
  SET domain-containing protein 5 (1382-1389)
cugcccagcgaccucagaaccauc

SEQ ID NO: 69852 - RNA, 48 nt, Artificial Sequence
  Cathepsin F (337-352)
cugcccagcaacgccuacuccgcuaucaagaaucucggcgggcuugag

SEQ ID NO: 69853 - RNA, 27 nt, Artificial Sequence
  Ropporin-1B (99-107)
cugcccaccgaccucuucaacagcgug

SEQ ID NO: 69854 - RNA, 24 nt, Artificial Sequence
  AP-5 complex subunit zeta-1 (154-161)
cugcccgugauggccaaggucguu

SEQ ID NO: 69855 - RNA, 24 nt, Artificial Sequence
  Rho guanine nucleotide exchange factor 2 (884-891)
cugcccgugaccacaagaagcguc

SEQ ID NO: 69856 - RNA, 24 nt, Artificial Sequence
  Protein O-mannosyl-transferase 1 (538-545)
cugcccgugguccuccagcacauc

SEQ ID NO: 69857 - RNA, 27 nt, Artificial Sequence
  Histone-lysine N-methyltransferase 2A (1096-1104)
cugcccugggaggaaagagagaagauc

SEQ ID NO: 69858 - RNA, 27 nt, Artificial Sequence
  Lathosterol oxidase (84-92)
cugcccuggaucagcauucucaccgug

SEQ ID NO: 69859 - RNA, 27 nt, Artificial Sequence
  Metallophosphoesterase MPPED2 (106-114)
cugcccuacgaguauaagaucgugauu

SEQ ID NO: 69860 - RNA, 24 nt, Artificial Sequence
  Glia-derived nexin (256-263)
cugcccuaccacggcgagagcauc

SEQ ID NO: 69861 - RNA, 30 nt, Artificial Sequence; identical to SEQ ID NO: 45634
  Glia-derived nexin (256-265)

SEQ ID NO: 69862 - RNA, 24 nt, Artificial Sequence
  Neurofibromin (488-495)
cugcccuaccucuuccacgugguc

SEQ ID NO: 69863 - RNA, 30 nt, Artificial Sequence
  NAD-dependent protein deacetylase sirtuin-2 (95-104)
cugcccuacccugaggccaucuucgaaauu

SEQ ID NO: 69864 - RNA, 30 nt, Artificial Sequence
  NAD-dependent protein deacetylase sirtuin-3, mitochondrial (173-182)
cugcccuacccugaggccaucuucgaacuc

SEQ ID NO: 69865 - RNA, 27 nt, Artificial Sequence
  CDK5 and ABL1 enzyme substrate 1 (27-35)
cugcccuacagagacagcacccaggug

SEQ ID NO: 69866 - RNA, 24 nt, Artificial Sequence
  Serpin B6 (104-111)
cugcccuacgugggcaaggagcuc

SEQ ID NO: 69867 - RNA, 33 nt, Artificial Sequence
  Guanine nucleotide exchange factor VAV3 (680-690)
cugcaggccgagaccgaacucaucaacagagug

SEQ ID NO: 69868 - RNA, 27 nt, Artificial Sequence
  Peroxisome proliferator-activated receptor gamma coactivator-related protein 1 (1097-1105)
cugcaggcccccgagcucgcuaacgug

SEQ ID NO: 69869 - RNA, 36 nt, Artificial Sequence
  Zinc finger homeobox protein 2 (544-555)
cugcagggcuuccaagccgggcccggaggucagggc

SEQ ID NO: 69870 - RNA, 48 nt, Artificial Sequence
  Proline-rich transmembrane protein 3 (172-187)
cugcagcacgagggccaagaagggcaguggcccccuagagacgaggga

SEQ ID NO: 69871 - RNA, 72 nt, Artificial Sequence
  Plectin (387-410)
cugcagauggaggccggccucugcgaagagcaacuuaaccaggcugacgcacuguugcagagcgaugugaga

SEQ ID NO: 69872 - RNA, 33 nt, Artificial Sequence
  T-complex protein 1 subunit gamma (268-278)
cugcagauggaggaagaguacauccaacagcuc

SEQ ID NO: 69873 - RNA, 42 nt, Artificial Sequence
  Glyceraldehyde-3-phosphate dehydrogenase (203-216)
cugcagaacaucauucccgccagcaccggcgcugcaaaggcc

SEQ ID NO: 69874 - RNA, 27 nt, Artificial Sequence
  Ubiquitin carboxyl-terminal hydrolase 22 (305-313)
cugcagagcgacgugaccugccaaguc

SEQ ID NO: 69875 - RNA, 24 nt, Artificial Sequence
  Titin (123-130)
cugcaggugagagucaccggcauc

SEQ ID NO: 69876 - RNA, 54 nt, Artificial Sequence
  Collagen alpha-1(VI) chain (694-711)
cugcaguggauggccggcgggaccuucacaggagaggcucuccaauacacuaga

SEQ ID NO: 69877 - RNA, 24 nt, Artificial Sequence
  Interferon regulatory factor 2-binding protein 1 (301-308)
cugagagagcccggcaaggcccuc

SEQ ID NO: 69878 - RNA, 33 nt, Artificial Sequence
  Disintegrin and metalloproteinase domain-containing protein 10 (60-70)
cugagacucgacuuccacgcccauggcaggcac

SEQ ID NO: 69879 - RNA, 30 nt, Artificial Sequence
  Keratin, type I cytoskeletal 10 (294-303)
cugagaaacgugagcaccggcgacgucaau

SEQ ID NO: 69880 - RNA, 33 nt, Artificial Sequence
  Casein kinase II subunit alpha (305-315)
cugagauacgaccaccagagcaggcucaccgcc

SEQ ID NO: 69881 - RNA, 39 nt, Artificial Sequence
  SKI family transcriptional corepressor 2 (329-341)
cugagcgccgcugcagccucccucucuguggcggcugcc

SEQ ID NO: 69882 - RNA, 27 nt, Artificial Sequence
  DNA-binding protein RFX7 (64-72)
cugagcgccgcugacuucggcaagauc

SEQ ID NO: 69883 - RNA, 57 nt, Artificial Sequence
  Heterogeneous nuclear ribonucleoprotein U (186-204)
cugagcgccuccucucucaccauggagucauucgcuuuucuuugggcaggcgggaga

SEQ ID NO: 69884 - RNA, 27 nt, Artificial Sequence
  Unconventional myosin-Ib (87-95)
cugagcgacgaggccuacagaucccuc

SEQ ID NO: 69885 - RNA, 27 nt, Artificial Sequence
  Leucine-tRNA ligase, cytoplasmic (166-174)
cugagcgacgaggaaaucgugaaguuc

SEQ ID NO: 69886 - RNA, 27 nt, Artificial Sequence
  1-phosphatidylinositol 4,5-bisphosphate phosphodiesterase beta-4 (725-733)
cugagcgacaagaaaaucggcaccuac

SEQ ID NO: 69887 - RNA, 27 nt, Artificial Sequence
  CCAAT/enhancer-binding protein beta (118-126)
cugagcgaccucuucuccgaugacuac

SEQ ID NO: 69888 - RNA, 27 nt, Artificial Sequence
  Ras association domain-containing protein 3 (88-96)
cugagcgacagagagcacccccucuac

SEQ ID NO: 69889 - RNA, 27 nt, Artificial Sequence
  Plexin-D1 (920-928)
cugagcgacguggcccacggcgucugg

SEQ ID NO: 69890 - RNA, 27 nt, Artificial Sequence
  Melanoma antigen preferentially expressed in tumors (334-342)
cugagcgagggcgacgugaugcaccuc

SEQ ID NO: 69891 - RNA, 27 nt, Artificial Sequence
  Putative pre-mRNA-splicing factor ATP-dependent RNA helicase DHX16 (506-514)
cugagcgagcccgaccucgccuccuac

SEQ ID NO: 69892 - RNA, 21 nt, Artificial Sequence
  Hemoglobin subunit alpha (6-12)
cugagcuuccccaccacaaag

SEQ ID NO: 69893 - RNA, 27 nt, Artificial Sequence
  Hemoglobin subunit alpha (6-14)
cugagcuuccccaccacaaagacuuac

SEQ ID NO: 69894 - RNA, 27 nt, Artificial Sequence
  Sister chromatid cohesion protein PDS5 homolog B (656-664)
cugagcuucacccaccccaucuccuuu

SEQ ID NO: 69895 - RNA, 30 nt, Artificial Sequence
  Zinc transporter ZIP12 (31-40)
cugagcggcgacgcccuccuucaccugauc

SEQ ID NO: 69896 - RNA, 30 nt, Artificial Sequence
  Asparagine synthetase (glutamine-hydrolyzing) (174-183)
cugagcggcgggcucgacuccucucuugug

SEQ ID NO: 69897 - RNA, 27 nt, Artificial Sequence
  Phosphorylase b kinase regulatory subunit alpha, liver isoform (46-54)
cugagcggccagcacggggugaccguc

SEQ ID NO: 69898 - RNA, 33 nt, Artificial Sequence
  PCNA-interacting partner (149-159)
cugagcauccccaccuccccuacaucuaaguac

SEQ ID NO: 69899 - RNA, 24 nt, Artificial Sequence
  Synemin (708-715)
cugagcaaggacaucaaagaggug

SEQ ID NO: 69900 - RNA, 24 nt, Artificial Sequence
  Ryanodine receptor 1 (442-449)
cugagccuccaggaccuuaucauu

SEQ ID NO: 69901 - RNA, 33 nt, Artificial Sequence
  Codanin-1 (382-392)
cugagcaaccucgacaagggcacccuuaaacug

SEQ ID NO: 69902 - RNA, 30 nt, Artificial Sequence
  Caprin-2 (108-117)
cugagcuccgccgcuucucccucacaggca

SEQ ID NO: 69903 - RNA, 57 nt, Artificial Sequence
  Protein unc-13 homolog D (375-393)
cugagcuccggccagaaggaccaagggcaggccgcuaacaugcucugcguggucguu

SEQ ID NO: 69904 - RNA, 30 nt, Artificial Sequence
  Melanocyte-stimulating hormone receptor (129-138)
cugagcucccucugcuuccuuggcgccauc

SEQ ID NO: 69905 - RNA, 27 nt, Artificial Sequence
  Protein prune homolog 2 (1282-1290)
cugagcucccccgagaccggcaaguac

SEQ ID NO: 69906 - RNA, 27 nt, Artificial Sequence
  Kelch-like protein 12 (386-394)
cugagcuccguggaggccuacaacauc

SEQ ID NO: 69907 - RNA, 36 nt, Artificial Sequence
  AP-2 complex subunit beta (710-721)
cugagcaccggcaucgggauggcccccggagguuac

SEQ ID NO: 69908 - RNA, 30 nt, Artificial Sequence; identical to SEQ ID NO: 45681
  Peroxisome assembly protein 12 (247-256)

SEQ ID NO: 69909 - RNA, 27 nt, Artificial Sequence
  Amyloid protein-binding protein 2 (472-480)
cugagcgugggccaccucgccucccuu

SEQ ID NO: 69910 - RNA, 21 nt, Artificial Sequence
  Serine/threonine-protein kinase mTOR (1960-1966)
cugaccgacaucggcagauac

SEQ ID NO: 69911 - RNA, 24 nt, Artificial Sequence
  Tyrosine-protein kinase BAZ1B (894-901)
cugaccgacaugaagcagguguuc

SEQ ID NO: 69912 - RNA, 30 nt, Artificial Sequence
  CDC2L5 protein kinase  (1231-1240)
cugaccgacccccacgccggcgugaaggcu

SEQ ID NO: 69913 - RNA, 27 nt, Artificial Sequence
  Zinc finger with UFM1-specific peptidase domain protein (139-147)
cugaccgagaucaagggcagcguguac

SEQ ID NO: 69914 - RNA, 24 nt, Artificial Sequence
  Protocadherin-15 (1267-1274)
cugaccgagauccucgacagauac

SEQ ID NO: 69915 - RNA, 27 nt, Artificial Sequence
  Beta-1-syntrophin (254-262)
cugaccgagaaggaccuccuuaucuac

SEQ ID NO: 69916 - RNA, 27 nt, Artificial Sequence
  Alpha-1-syntrophin (122-130)
cugaccgagaaggaacuccuucuguac

SEQ ID NO: 69917 - RNA, 27 nt, Artificial Sequence
  Nucleoprotein TPR (587-595)
cugaccgagcucgaacagcuuagaaag

SEQ ID NO: 69918 - RNA, 27 nt, Artificial Sequence
  Zinc finger MIZ domain-containing protein 1 (470-478)
cugaccuuccccgugagagacggcguc

SEQ ID NO: 69919 - RNA, 48 nt, Artificial Sequence
  Basement membrane-specific heparan sulfate proteoglycan core protein (350-365)
cugaccggcgaguucacaguggaacccgucccugagggggcccagcuc

SEQ ID NO: 69920 - RNA, 24 nt, Artificial Sequence
  Erythrocyte band 7 integral membrane protein (109-116)
cugaccaaggacagcgugacaauc

SEQ ID NO: 69921 - RNA, 27 nt, Artificial Sequence
  CCR4-NOT transcription complex subunit 1 (247-255)
cugaccaagcccaugcagauccucuac

SEQ ID NO: 69922 - RNA, 27 nt, Artificial Sequence
  Phenylalanine-tRNA ligase alpha subunit (381-389)
cugacccucggccaccuuaugggggug

SEQ ID NO: 69923 - RNA, 27 nt, Artificial Sequence
  Plectin (1055-1063)
cugacccucggcaagcuugagcaggug

SEQ ID NO: 69924 - RNA, 81 nt, Artificial Sequence
  POU domain, class 6, transcription factor 2 (131-157)
cugacccuccccacagccaaccuuacuaauauccagggccugguggcugcagccgcggcugggggaauuaugacguugccu

SEQ ID NO: 69925 - RNA, 27 nt, Artificial Sequence
  Cytoplasmic dynein 1 heavy chain 1 (469-477)
cugaccauggagaucaaccccaaggug

SEQ ID NO: 69926 - RNA, 30 nt, Artificial Sequence
  Plasma membrane calcium-transporting ATPase 1 (480-489)
cugaccaugaacagaaugacagugguccag

SEQ ID NO: 69927 - RNA, 36 nt, Artificial Sequence
  Insulin-like growth factor-binding protein complex acid labile subunit (399-410)
cugaccaacguggccgucaugaaucucagcggcaac

SEQ ID NO: 69928 - RNA, 27 nt, Artificial Sequence
  Peroxisomal acyl-coenzyme A oxidase 1 (273-281)
cugaccuacggcacaaugguguucguc

SEQ ID NO: 69929 - RNA, 36 nt, Artificial Sequence
  Potassium/sodium hyperpolarization-activated cyclic nucleotide-gated channel 4 (1006-1017)
cugguggccggcgcuagcgggggagcaucccccguc

SEQ ID NO: 69930 - RNA, 30 nt, Artificial Sequence
  ER membrane protein complex subunit 7 (68-77)
cugguggacggcgaggaacacgucggguuc

SEQ ID NO: 69931 - RNA, 24 nt, Artificial Sequence
  Manganese-transporting ATPase 13A1 (282-289)
cugguggacauccccgucgaguuc

SEQ ID NO: 69932 - RNA, 27 nt, Artificial Sequence
  Supervillin (1622-1630)
cugguggacaaccaccaugaggucuac

SEQ ID NO: 69933 - RNA, 27 nt, Artificial Sequence
  Aldehyde dehydrogenase family 1 member A3 (106-114)
cugguggagagagacagggccacccuc

SEQ ID NO: 69934 - RNA, 27 nt, Artificial Sequence
  A-kinase anchor protein 11 (654-662)
cugguguucgagggcaucauggaaguc

SEQ ID NO: 69935 - RNA, 30 nt, Artificial Sequence
  Serum albumin (66-75)
cuggugaacgaggucaccgaauucgccaag

SEQ ID NO: 69936 - RNA, 24 nt, Artificial Sequence
  Cytochrome c oxidase subunit 5B, mitochondrial (122-129)
cuggugccccagcaacucgcccac

SEQ ID NO: 69937 - RNA, 30 nt, Artificial Sequence
  Stabilin-2 (1032-1041)
cuggugcccagccagcaagccaccgaggac

SEQ ID NO: 69938 - RNA, 24 nt, Artificial Sequence
  Adenomatous polyposis coli protein 2 (11-18)
cuggugagacaggucgaggcccuc

SEQ ID NO: 69939 - RNA, 48 nt, Artificial Sequence
  60S ribosomal protein L9 (153-168)
cuggugagcaacuccgccgcucucauccagcaagcaaccacagucaag

SEQ ID NO: 69940 - RNA, 33 nt, Artificial Sequence
  Thioredoxin reductase 2, mitochondrial (4-14)
cugguggucggcgggggaagcgguggccucgcc

SEQ ID NO: 69941 - RNA, 27 nt, Artificial Sequence
  Midasin (3107-3115)
cugguggucagcgacggcagagggcuc

SEQ ID NO: 69942 - RNA, 30 nt, Artificial Sequence
  Kelch-like protein 29 (511-520)
cugguguacgacggcaagaucuauacccuc

SEQ ID NO: 69943 - RNA, 27 nt, Artificial Sequence
  Pre-mRNA-processing-splicing factor 8 (405-413)
cugugggcccccagaccuuucaaccuc

SEQ ID NO: 69944 - RNA, 27 nt, Artificial Sequence
  Plexin-B3 (1462-1470)
cuguacgccuuccucagagagguggcu

SEQ ID NO: 69945 - RNA, 30 nt, Artificial Sequence
  Aldehyde dehydrogenase family 1 member A3 (471-480)
cuguacgcccaggcucccuucggcggguuu

SEQ ID NO: 69946 - RNA, 27 nt, Artificial Sequence
  DNA-binding protein RFXANK (131-139)
cuguacgccgugagaggcaaccacguc

SEQ ID NO: 69947 - RNA, 27 nt, Artificial Sequence
  Asparagine synthetase (glutamine-hydrolyzing) (132-140)
cuguacgacaacguggagaagcucuuc

SEQ ID NO: 69948 - RNA, 24 nt, Artificial Sequence
  Mediator of RNA polymerase II transcription subunit 12 (572-579)
cuguacgaccagcccagacacgug

SEQ ID NO: 69949 - RNA, 24 nt, Artificial Sequence
  Signal recognition particle subunit SRP68 (454-461)
cuguacgacagagugcucaaguau

SEQ ID NO: 69950 - RNA, 27 nt, Artificial Sequence
  GPI mannosyltransferase 2 (80-88)
cuguacgagcacaacuucgccuuuuuc

SEQ ID NO: 69951 - RNA, 27 nt, Artificial Sequence
  Hemicentin-1 (1595-1603)
cuguacaucgacaagggccaguaucuc

SEQ ID NO: 69952 - RNA, 27 nt, Artificial Sequence
  Cleavage and polyadenylation specificity factor subunit 6 (83-91)
cuguacaucggcaaccucaccuggugg

SEQ ID NO: 69953 - RNA, 27 nt, Artificial Sequence
  Myotubularin-related protein 12 (484-492)
cuguacauccccauuuucagcaccuuu

SEQ ID NO: 69954 - RNA, 27 nt, Artificial Sequence
  Disintegrin and metalloproteinase domain-containing protein 10 (167-175)
cuguacauccagaccgaccaccucuuc

SEQ ID NO: 69955 - RNA, 27 nt, Artificial Sequence
  SUN domain-containing ossification factor (723-731)
cuguacaucguggagccccucaaguuc

SEQ ID NO: 69956 - RNA, 30 nt, Artificial Sequence
  Solute carrier family 25 member 34 (267-276)
cuguacaagggccucgggcccgccuaucuu

SEQ ID NO: 69957 - RNA, 27 nt, Artificial Sequence
  ER membrane protein complex subunit 1 (731-739)
cuguacaagagccucaaccccaaucuu

SEQ ID NO: 69958 - RNA, 27 nt, Artificial Sequence
  NTF2-related export protein 2 (39-47)
cuguaccucgacaaggccacccuuauc

SEQ ID NO: 69959 - RNA, 30 nt, Artificial Sequence
  NTF2-related export protein 2 (39-48)
cuguaccucgacaaggccacccuuaucugg

SEQ ID NO: 69960 - RNA, 27 nt, Artificial Sequence
  SWI/SNF-related matrix-associated actin-dependent regulator of chromatin subfamily A containing DEAD/H box 1 (320-328)
cuguaccucggccuuuucaacagacug

SEQ ID NO: 69961 - RNA, 27 nt, Artificial Sequence
  Protein CLN8 (226-234)
cuguaccucccccaccuuacccuguuc

SEQ ID NO: 69962 - RNA, 21 nt, Artificial Sequence
  Mitochondrial carrier homolog 1 (63-69)
cuguaccuccccagcuucuuu

SEQ ID NO: 69963 - RNA, 27 nt, Artificial Sequence
  DnaJ homolog subfamily A member 2 (129-137)
cuguacaacggcaagaccacaaaacuc

SEQ ID NO: 69964 - RNA, 33 nt, Artificial Sequence
  Melanocyte protein PMEL (55-65)
cuguaccccgaguggaccgaagcccagagacuc

SEQ ID NO: 69965 - RNA, 27 nt, Artificial Sequence
  Protein transport protein Sec23B (560-568)
cuguacccccaguucauguuucaccuc

SEQ ID NO: 69966 - RNA, 27 nt, Artificial Sequence
  Vacuolar protein sorting-associated protein 4A (31-39)
cuguaccagcacgccguggaguauuuc

SEQ ID NO: 69967 - RNA, 27 nt, Artificial Sequence
  CCAAT/enhancer-binding protein zeta (212-220)
cuguaccagcacgagaucaaccucuuc

SEQ ID NO: 69968 - RNA, 27 nt, Artificial Sequence
  Engulfment and cell motility protein 2 (207-215)
cuguaccagaagaucgccgaggaaauu

SEQ ID NO: 69969 - RNA, 24 nt, Artificial Sequence
  E3 ubiquitin-protein ligase UBR5 (1255-1262)
cuguacagacuccuuaccgccaca

SEQ ID NO: 69970 - RNA, 27 nt, Artificial Sequence
  Unconventional myosin-Ib (356-364)
cuguacagcagacucuucuccuggcuu

SEQ ID NO: 69971 - RNA, 27 nt, Artificial Sequence
  Ubiquitin-like modifier-activating enzyme 7 (14-22)
cuguacagcagacagcucuaugugcuu

SEQ ID NO: 69972 - RNA, 24 nt, Artificial Sequence
  Mitochondrial ubiquitin ligase activator of NFKB 1 (25-32)
cuguacagcguguauagacagaag

SEQ ID NO: 69973 - RNA, 27 nt, Artificial Sequence
  Melanoma antigen preferentially expressed in tumors (301-309)
cuguacguggacagccucuucuuucuu

SEQ ID NO: 69974 - RNA, 27 nt, Artificial Sequence
  Beta-galactosidase-1-like protein (586-594)
cuguacgugcccagauuccuccuuuuu

SEQ ID NO: 69975 - RNA, 24 nt, Artificial Sequence
  40S ribosomal protein S29 (6-13)
cuguacuggagccaccccagaaag

SEQ ID NO: 69976 - RNA, 39 nt, Artificial Sequence
  Mitogen-activated protein kinase 1 (1-13)
auggccgcugcagccgcggcuggcgccgggcccgagaug

SEQ ID NO: 69977 - RNA, 27 nt, Artificial Sequence
  B-cell CLL/lymphoma 9-like protein (186-194)
auggccgcuccccagcugggcccuggg

SEQ ID NO: 69978 - RNA, 30 nt, Artificial Sequence
  Glucosylceramidase (21-30)
auggccggcagccugaccgggcuccuucug

SEQ ID NO: 69979 - RNA, 24 nt, Artificial Sequence
  Dystonin (1657-1664)
auggccaucaaggugcuggagauu

SEQ ID NO: 69980 - RNA, 24 nt, Artificial Sequence
  BRAF (48-55)
auggcccccgaggugaucagaaug

SEQ ID NO: 69981 - RNA, 24 nt, Artificial Sequence
  HLA class I histocompatibility antigen, alpha chain F (1-8)
auggcccccagaagccugcuccuu

SEQ ID NO: 69982 - RNA, 24 nt, Artificial Sequence
  HLA class I histocompatibility antigen, B-39 alpha chain (4-11)
auggcccccagaaccgugcugcuc

SEQ ID NO: 69983 - RNA, 48 nt, Artificial Sequence
  Gamma-secretase C-terminal fragment 59 (561-576)
auggacgccgaguucagacacgauagcggcuacgaagugcaucaccag

SEQ ID NO: 69984 - RNA, 48 nt, Artificial Sequence
  Dihydropyrimidinase-related protein 2 (339-354)
auggacgagaaccaguucguggccgucaccagcacaaaugcugcaaag

SEQ ID NO: 69985 - RNA, 21 nt, Artificial Sequence
  Insulin receptor substrate 2 (545-551)
auggacagaccccugagccac

SEQ ID NO: 69986 - RNA, 27 nt, Artificial Sequence
  Receptor-type tyrosine-protein phosphatase gamma (796-804)
auggaggccauccccgugaagcaguuc

SEQ ID NO: 69987 - RNA, 30 nt, Artificial Sequence; identical to SEQ ID NO: 45760
  Protein wntless homolog (185-194)

SEQ ID NO: 69988 - RNA, 27 nt, Artificial Sequence
  Tyrosinase (516-524)
auggagaaggaagacuaccacagccug

SEQ ID NO: 69989 - RNA, 30 nt, Artificial Sequence; identical to SEQ ID NO: 45762
  PRELI domain containing protein 3B (91-100)

SEQ ID NO: 69990 - RNA, 30 nt, Artificial Sequence
  Fructose-bisphosphate aldolase A (219-228)
auggagaacgccaaugugcuggcuagauac

SEQ ID NO: 69991 - RNA, 30 nt, Artificial Sequence; identical to SEQ ID NO: 45764
  Poly(U)-binding-splicing factor PUF60 (74-83)

SEQ ID NO: 69992 - RNA, 30 nt, Artificial Sequence; identical to SEQ ID NO: 45765
  Melanoma-associated antigen 3 (167-176)

SEQ ID NO: 69993 - RNA, 24 nt, Artificial Sequence
  Synemin (37-44)
auguucgacaagaaagugcagcug

SEQ ID NO: 69994 - RNA, 18 nt, Artificial Sequence
  Proliferating cell nuclear antigen (244-249)
augggccaccugaaguac

SEQ ID NO: 69995 - RNA, 60 nt, Artificial Sequence
  Actin, aortic smooth muscle (49-68)
augggccagaaggacagcuacgugggggaugaggcccaauccaaaagaggaauccugacc

SEQ ID NO: 69996 - RNA, 24 nt, Artificial Sequence
  Ankyrin-1 (733-740)
augggcuacaccccccugcacgug

SEQ ID NO: 69997 - RNA, 21 nt, Artificial Sequence
  Dynein light chain roadblock-type 1 (53-59)
augcacagcuucauccugaag

SEQ ID NO: 69998 - RNA, 27 nt, Artificial Sequence
  Glycogen phosphorylase, liver form (619-627)
augaucauuaagcugauaaccagcgug

SEQ ID NO: 69999 - RNA, 27 nt, Artificial Sequence
  Phenylalanine-tRNA ligase alpha subunit (465-473)
augaucaaguacggcauuaacaauaua

SEQ ID NO: 70000 - RNA, 30 nt, Artificial Sequence
  Malate dehydrogenase, mitochondrial (273-282)
augaucagcgacgccauucccgagcugaag

SEQ ID NO: 70001 - RNA, 27 nt, Artificial Sequence
  ER membrane protein complex subunit 1 (976-984)
augaucaccaagagacuggcccaggug

SEQ ID NO: 70002 - RNA, 27 nt, Artificial Sequence
  Huntingtin (537-545)
augaucaccacacaccccgcccuggug

SEQ ID NO: 70003 - RNA, 27 nt, Artificial Sequence
  EH domain-containing protein 3 (385-393)
augcuggcccacgacaucgcucagcuc

SEQ ID NO: 70004 - RNA, 24 nt, Artificial Sequence
  Chondroitin sulfate proteoglycan 4 (22-29)
augcuggccagacucgcuagcgca

SEQ ID NO: 70005 - RNA, 33 nt, Artificial Sequence
  COP9 signalosome complex subunit 1 (344-354)
augcuggacgagaugaaggauaaccuccuucug

SEQ ID NO: 70006 - RNA, 33 nt, Artificial Sequence
  Baculoviral IAP repeat-containing protein 6 (1752-1762)
augcuggaggacgaaaaggugaccauguuccuc

SEQ ID NO: 70007 - RNA, 21 nt, Artificial Sequence
  Spectrin beta chain, non-erythrocytic 4 (2042-2048)
augcuggaggugcaccaguuc

SEQ ID NO: 70008 - RNA, 27 nt, Artificial Sequence
  Mitotic checkpoint serine/threonine-protein kinase BUB1 (998-1006)
augcuguucggcaccuacaugaaggug

SEQ ID NO: 70009 - RNA, 24 nt, Artificial Sequence
  Collagen alpha-1(XVIII) chain (1454-1461)
augcugggccaggugcacgagguc

SEQ ID NO: 70010 - RNA, 27 nt, Artificial Sequence
  Tetratricopeptide repeat protein 28 (1354-1362)
augcugaucggcagcgacgugaagcuc

SEQ ID NO: 70011 - RNA, 27 nt, Artificial Sequence
  Phosphatidylinositol 5-phosphate 4-kinase type-2 beta (65-73)
augcugaugcccgacgauuucaaggcc

SEQ ID NO: 70012 - RNA, 66 nt, Artificial Sequence
  T-complex protein 1 subunit beta (445-466)
augcugcccaccaucauugccgacaacgcuggcuacgauagcgcagaccucguggcccagcuuaga

SEQ ID NO: 70013 - RNA, 27 nt, Artificial Sequence
  DNA-binding protein SATB2 (142-150)
augcugcaggacguguaccacgucguu

SEQ ID NO: 70014 - RNA, 174 nt, Artificial Sequence
  6.8 kDa mitochondrial proteolipid (1-58)
augcugcagagcaucauuaagaacauauggauccccaugaaaccuuacuauaccaagguguaccaagagauuuggaucggcauggggcucaugggauucauugucuauaaaaucagagccgcugacaagagguccaaagcacuuaaggccucugcgccagcuccgggucaccau

SEQ ID NO: 70015 - RNA, 30 nt, Artificial Sequence; identical to SEQ ID NO: 45788
  BTB/POZ domain-containing protein KCTD3 (428-437)

SEQ ID NO: 70016 - RNA, 27 nt, Artificial Sequence
  Death-associated protein kinase 1 (763-771)
augauguucgagcccggccugaccaag

SEQ ID NO: 70017 - RNA, 27 nt, Artificial Sequence
  RB1-inducible coiled-coil protein 1 (107-115)
augaugcccgccguguuccacaccguc

SEQ ID NO: 70018 - RNA, 48 nt, Artificial Sequence
  Exostosin-like 1 (589-604)
augaacuucaucguggccgcugucaccaagcugcccccuauuaaaguu

SEQ ID NO: 70019 - RNA, 27 nt, Artificial Sequence
  Sodium/potassium/calcium exchanger 5 (298-306)
augcccgaggccgaccugaagagaauc

SEQ ID NO: 70020 - RNA, 24 nt, Artificial Sequence
  Filamin-B (1129-1136)
augcccuucgacccuagcaaggug

SEQ ID NO: 70021 - RNA, 69 nt, Artificial Sequence
  Heat shock cognate 71 kDa protein (621-643)
augcccggcggguucccuggagguggcgccccaccgagcgggggagcuuccucuggccccaccaucgag

SEQ ID NO: 70022 - RNA, 27 nt, Artificial Sequence
  Protein polybromo-1 (1078-1086)
augcccaucagcuccgugagauucguc

SEQ ID NO: 70023 - RNA, 27 nt, Artificial Sequence
  Malignant T-cell-amplified sequence 1 (45-53)
augcccaagaaagacccugugaagauc

SEQ ID NO: 70024 - RNA, 27 nt, Artificial Sequence
  Melanoma antigen preferentially expressed in tumors (218-226)
augcccaugcaggacaucaagaugauu

SEQ ID NO: 70025 - RNA, 27 nt, Artificial Sequence
  Nuclear factor related to kappa-B-binding protein (810-818)
augcccccuaaggccggccagaccauc

SEQ ID NO: 70026 - RNA, 27 nt, Artificial Sequence
  E3 ubiquitin-protein ligase Itchy homolog (380-388)
augccccagcacaucaagauuaccgug

SEQ ID NO: 70027 - RNA, 39 nt, Artificial Sequence
  Myotubularin-related protein 5 (315-327)
augcccagauacgccgacgcuagcggcaggaacacccug

SEQ ID NO: 70028 - RNA, 30 nt, Artificial Sequence
  Splicing factor 3B subunit 2 (596-605)
augcccgugggcccuaacgcccacaagguc

SEQ ID NO: 70029 - RNA, 27 nt, Artificial Sequence
  Zinc finger protein 512B (211-219)
augcccgugaccaagccuaucacaguc

SEQ ID NO: 70030 - RNA, 27 nt, Artificial Sequence
  Dihydropyrimidinase-related protein 3 (192-200)
augcccuacaagggcaugaccacagug

SEQ ID NO: 70031 - RNA, 21 nt, Artificial Sequence
  Transmembraneoprotein NMB (38-44)
augagagagcacaaccagcug

SEQ ID NO: 70032 - RNA, 27 nt, Artificial Sequence
  WD repeat-containing protein 81 (60-68)
augagcgaggaacacaccgccguguac

SEQ ID NO: 70033 - RNA, 27 nt, Artificial Sequence
  Bombesin receptor-activated protein C6orf89 (44-52)
augagcgagaaggccaucgaaaaauuc

SEQ ID NO: 70034 - RNA, 27 nt, Artificial Sequence
  Inactive ubiquitin carboxyl-terminal hydrolase 53 (1045-1053)
augaccgacacauacagacugaaguau

SEQ ID NO: 70035 - RNA, 18 nt, Artificial Sequence
  Neuronal membraneoprotein M6-a (202-207)
augaccuuccaccuguuu

SEQ ID NO: 70036 - RNA, 87 nt, Artificial Sequence
  POTE ankyrin domain family member I (36-64)
augacccagaucauguucgagacauuuaacacucccgccauguacguggcuauucaagcaguccugagccucuaugccuccggcaga

SEQ ID NO: 70037 - RNA, 36 nt, Artificial Sequence
  Protein disulfide-isomerase A3 (285-296)
augguggccaagaaauuccuggacgcuggccacaag

SEQ ID NO: 70038 - RNA, 24 nt, Artificial Sequence
  Unconventional myosin-Id (310-317)
augguggagaaggcccugcucuac

SEQ ID NO: 70039 - RNA, 27 nt, Artificial Sequence
  Putative eukaryotic translation initiation factor 2 subunit 3-like protein (353-361)
auggugggccagauccugggggccguc

SEQ ID NO: 70040 - RNA, 42 nt, Artificial Sequence
  MICOS complex subunit MIC60 (88-101)
auggugcugggccccgccgcuuacaacgucccucucccaaag

SEQ ID NO: 70041 - RNA, 27 nt, Artificial Sequence
  ER membrane protein complex subunit 7 (169-177)
auggugcugccccuccuuaucuucguc

SEQ ID NO: 70042 - RNA, 69 nt, Artificial Sequence
  X-ray repair cross-complementing protein 5 (210-232)
auggugaugaucagccuggagggcgaagacgggcucgaugagauuuacuccuucucugaaucacuuaga

SEQ ID NO: 70043 - RNA, 30 nt, Artificial Sequence
  Threonine-tRNA ligase, cytoplasmic (655-664)
auggugguccccguuggcccuaccugcgac

SEQ ID NO: 70044 - RNA, 30 nt, Artificial Sequence
  NAD(P)H dehydrogenase (quinone) 1 (129-138)
auguacgacaagggccccuucagaagcaaa

SEQ ID NO: 70045 - RNA, 30 nt, Artificial Sequence
  Exportin-1 (545-554)
auguacaucgugggccaguaucccagauuc

SEQ ID NO: 70046 - RNA, 27 nt, Artificial Sequence
  MICOS complex subunit MIC25 (169-177)
auguacaagcugagcuccgagcaguuc

SEQ ID NO: 70047 - RNA, 27 nt, Artificial Sequence
  F-box only protein 21 (417-425)
auguaccccgaccaggugcaacugcuc

SEQ ID NO: 70048 - RNA, 30 nt, Artificial Sequence
  Sodium/potassium-transporting ATPase subunit alpha-1 (980-989)
auguacccccugaagccuaccuggugguuc

SEQ ID NO: 70049 - RNA, 27 nt, Artificial Sequence
  Sphingomyelin phosphodiesterase 4 (377-385)
auguacaccaagcuguucgugggcuuu

SEQ ID NO: 70050 - RNA, 33 nt, Artificial Sequence
  DNA-binding protein SATB1 (453-463)
aacgccgcuagcgcaaugggccccgccccucug

SEQ ID NO: 70051 - RNA, 30 nt, Artificial Sequence
  Eukaryotic translation initiation factor 3 subunit L (169-178)
aacgccgacggccccgcuccucuggagcuc

SEQ ID NO: 70052 - RNA, 27 nt, Artificial Sequence
  Far upstream element-binding protein 1 (418-426)
aacgccgaccccaauaugaagcuguuc

SEQ ID NO: 70053 - RNA, 27 nt, Artificial Sequence
  Erythrocyte band 7 integral membrane protein (138-146)
aacgccgacagcgcuaccagacugcuc

SEQ ID NO: 70054 - RNA, 27 nt, Artificial Sequence
  AP-2 complex subunit beta (874-882)
aacgccgacaccgugagcuccaagcug

SEQ ID NO: 70055 - RNA, 27 nt, Artificial Sequence
  CD44 antigen (137-145)
aacgccuucgacggccccaucaccauu

SEQ ID NO: 70056 - RNA, 36 nt, Artificial Sequence
  Catenin alpha-1 (43-54)
aacgccggcaaugagcaggaccuggggauccaauac

SEQ ID NO: 70057 - RNA, 24 nt, Artificial Sequence
  Helicase-like transcription factor (96-103)
aacgccaucaaggugaauaacguc

SEQ ID NO: 70058 - RNA, 24 nt, Artificial Sequence
  Similar to 60S ribosomal protein L7 (171-178)
aacgcccugaucgcuagaagccuc

SEQ ID NO: 70059 - RNA, 33 nt, Artificial Sequence
  Forkhead box protein C1 (212-222)
aacgcccccggcccucagccaccgcccgugaga

SEQ ID NO: 70060 - RNA, 24 nt, Artificial Sequence
  Serine/threonine-protein phosphatase 2A regulatory subunit B'' subunit alpha (81-88)
aacgccccccugagcaucaauauu

SEQ ID NO: 70061 - RNA, 21 nt, Artificial Sequence
  Protein FAM208B (1664-1670)
aacgccacccugacacacuac

SEQ ID NO: 70062 - RNA, 24 nt, Artificial Sequence
  Rho guanine nucleotide exchange factor 11 (1029-1036)
aacgccgugcugaucagaagcguc

SEQ ID NO: 70063 - RNA, 30 nt, Artificial Sequence
  T-complex protein 1 subunit theta (48-57)
aacgacgccgcuaccauccugagagagcuc

SEQ ID NO: 70064 - RNA, 27 nt, Artificial Sequence
  Pumilio homolog 2 (927-935)
aacgacggcccccacagcgcccuguac

SEQ ID NO: 70065 - RNA, 24 nt, Artificial Sequence
  Ribonuclease P protein subunit p21 (126-133)
aacgaccccggccaccugcucugg

SEQ ID NO: 70066 - RNA, 30 nt, Artificial Sequence
  Protein TANC1 (587-596)
aacgaggccgaauuccacaagcccgacuac

SEQ ID NO: 70067 - RNA, 30 nt, Artificial Sequence
  Hemicentin-1 (2650-2659)
aacgaggccggcgaaaugaucaagcacuac

SEQ ID NO: 70068 - RNA, 30 nt, Artificial Sequence
  Hemicentin-1 (3510-3519)
aacgaggccggcgaagugagcaagcacuuc

SEQ ID NO: 70069 - RNA, 30 nt, Artificial Sequence
  E3 ubiquitin-protein ligase MYCBP2 (2115-2124)
aacgaggcccuguucagccucgaaaccgcu

SEQ ID NO: 70070 - RNA, 27 nt, Artificial Sequence
  Insulin-like growth factor 1 receptor (1048-1056)
aacgaggccagcgugaugaaggaauuc

SEQ ID NO: 70071 - RNA, 30 nt, Artificial Sequence; identical to SEQ ID NO: 45844
  Neutral amino acid transporter B(0) (61-70)

SEQ ID NO: 70072 - RNA, 27 nt, Artificial Sequence
  Kinesin-like protein KIF13B (360-368)
aacgaggaccccaaugccagaaucauu

SEQ ID NO: 70073 - RNA, 27 nt, Artificial Sequence
  Smith-Magenis syndrome chromosomal region candidate gene 8 protein (896-904)
aacgaggacgugagagucguucaguac

SEQ ID NO: 70074 - RNA, 27 nt, Artificial Sequence
  RNA-binding motif, single-stranded-interacting protein 3 (399-407)
aacgagcacgcccccgcuuacagcuau

SEQ ID NO: 70075 - RNA, 30 nt, Artificial Sequence
  2-hydroxyacylsphingosine 1-beta-galactosyltransferase (284-293)
aacgagcacggcuucgugcuggucagcuuu

SEQ ID NO: 70076 - RNA, 30 nt, Artificial Sequence
  Protocadherin gamma-A9 (143-152)
aacgagaucgccgugcccggcgcuagauac

SEQ ID NO: 70077 - RNA, 33 nt, Artificial Sequence
  Protein transport protein Sec23A (436-446)
aacgagaucggcaccgggggaacaugccagugg

SEQ ID NO: 70078 - RNA, 30 nt, Artificial Sequence
  Serine incorporator 3 (396-405)
aacgagaaggaaggcgugcaguacagcuau

SEQ ID NO: 70079 - RNA, 27 nt, Artificial Sequence
  Pre-rRNA-processing protein TSR1 homolog (69-77)
aacgagcugggcaauacccagaacuuc

SEQ ID NO: 70080 - RNA, 27 nt, Artificial Sequence
  T-box transcription factor TBX2 (676-684)
aacgagcugcagagcauccaaagacuc

SEQ ID NO: 70081 - RNA, 27 nt, Artificial Sequence
  Spectrin beta chain, non-erythrocytic 1 (32-40)
aacgagaauagcuccgccagacuguuc

SEQ ID NO: 70082 - RNA, 27 nt, Artificial Sequence
  Cytoplasmic FMR1-interacting protein 2 (99-107)
aacgagcagcccaauagaguggaaauc

SEQ ID NO: 70083 - RNA, 30 nt, Artificial Sequence
  Serine incorporator 1 (377-386)
aacgagagagacggcgugaccuacagcuau

SEQ ID NO: 70084 - RNA, 27 nt, Artificial Sequence
  Transcription factor SOX-10 (146-154)
aacgagagcgacaagagacccuucauc

SEQ ID NO: 70085 - RNA, 27 nt, Artificial Sequence
  Laminin subunit beta-1 (541-549)
aacgagguggaacccggcuacuauuuc

SEQ ID NO: 70086 - RNA, 21 nt, Artificial Sequence
  AP-1 complex subunit sigma-1A (105-111)
aacuucgagaaggccuacuuu

SEQ ID NO: 70087 - RNA, 18 nt, Artificial Sequence
  Serine/threonine-protein phosphatase 2A 55 kDa regulatory subunit B alpha isoform (364-369)
aacuucuuuagaauguuc

SEQ ID NO: 70088 - RNA, 27 nt, Artificial Sequence
  Astrotactin-2 (354-362)
aacuucaucaaggacuuuccccagcug

SEQ ID NO: 70089 - RNA, 21 nt, Artificial Sequence
  Absent in melanoma 1 protein (1462-1468)
aacuucaccggcaaucaguac

SEQ ID NO: 70090 - RNA, 24 nt, Artificial Sequence
  RNA-binding protein 12B (194-201)
aacggcgacgccaucgugaaguuc

SEQ ID NO: 70091 - RNA, 27 nt, Artificial Sequence
  Receptor-interacting serine/threonine-protein kinase 4 (562-570)
aacggcgacgagagcuccaccagacug

SEQ ID NO: 70092 - RNA, 24 nt, Artificial Sequence
  Ankyrin-1 (403-410)
aacggcuucaccccccugcacauc

SEQ ID NO: 70093 - RNA, 33 nt, Artificial Sequence
  Insulin-like growth factor-binding protein complex acid labile subunit (458-468)
aacggccugguggggaucgaggaacagagccuc

SEQ ID NO: 70094 - RNA, 78 nt, Artificial Sequence
  RNA-binding protein Nova-2 (369-394)
aacggcuaccugggggccggagcugguggcggggcaggaggcggugggggaccccucguggccgcggcugccgcagcc

SEQ ID NO: 70095 - RNA, 24 nt, Artificial Sequence
  Ankyrin-1 (634-641)
aacggcuacaccccccugcacauc

SEQ ID NO: 70096 - RNA, 30 nt, Artificial Sequence; identical to SEQ ID NO: 45869
  Hemicentin-1 (4034-4043)

SEQ ID NO: 70097 - RNA, 45 nt, Artificial Sequence
  Tyrosine-protein phosphatase non-receptor type substrate 1 (452-466)
aaccacaccgaguacgccagcauccagacauccccccaaccugcu

SEQ ID NO: 70098 - RNA, 51 nt, Artificial Sequence
  Tyrosine-protein phosphatase non-receptor type substrate 1 (452-468)
aaccacaccgaguacgccagcauccagacauccccccaaccugcuucugaa

SEQ ID NO: 70099 - RNA, 54 nt, Artificial Sequence
  Tyrosine-protein phosphatase non-receptor type substrate 1 (452-469)
aaccacaccgaguacgccagcauccagacauccccccaaccugcuucugaagac

SEQ ID NO: 70100 - RNA, 60 nt, Artificial Sequence
  Cytochrome c oxidase subunit 6A1, mitochondrial (67-86)
aaccacacccuguuccauaauccccacgugaacccucucccaacaggcuacgaggacgaa

SEQ ID NO: 70101 - RNA, 51 nt, Artificial Sequence
  Beta-2-microglobulin (82-98)
aaccacgugacccugagccagcccaagaucgucaaaugggacagagauaug

SEQ ID NO: 70102 - RNA, 18 nt, Artificial Sequence
  Ketosamine-3-kinase (149-154)
aaccacuggaaucauuuc

SEQ ID NO: 70103 - RNA, 27 nt, Artificial Sequence
  Probable ATP-dependent RNA helicase YTHDC2 (689-697)
aacaucgccgagaccagcauuacagug

SEQ ID NO: 70104 - RNA, 30 nt, Artificial Sequence
  Retinoic acid receptor RXR-gamma (268-277)
aacaucugccacgccgcugacaagcagcug

SEQ ID NO: 70105 - RNA, 27 nt, Artificial Sequence
  ATP-dependent RNA helicase A (346-354)
aacaucgacgagggcccccuggccuuc

SEQ ID NO: 70106 - RNA, 27 nt, Artificial Sequence
  P2X purinoceptor 7 (195-203)
aacaucgacuuccccggccacaauuac

SEQ ID NO: 70107 - RNA, 45 nt, Artificial Sequence
  Tyrosinase (122-136)
aacaucuucgaccugagcgcccccgagaaggauaaauuuuucgcu

SEQ ID NO: 70108 - RNA, 36 nt, Artificial Sequence
  Glyceraldehyde-3-phosphate dehydrogenase, testis-specific (277-288)
aacaucauucccgccagcaccggcgcugcaaaggcc

SEQ ID NO: 70109 - RNA, 27 nt, Artificial Sequence
  SLIT-ROBO Rho GTPase-activating protein 2 (123-131)
aacaucauucccagauucgugcagguc

SEQ ID NO: 70110 - RNA, 27 nt, Artificial Sequence
  Heterogeneous nuclear ribonucleoprotein U-like protein 1 (451-459)
aacauccugggcaccaaugccauuaug

SEQ ID NO: 70111 - RNA, 78 nt, Artificial Sequence
  ATP synthase-coupling factor 6, mitochondrial (33-58)
aacaaggagcuggaccccauccagaaacucuucguggauaagauuagagaauacaaaagcaagaggcaaaccuccggc

SEQ ID NO: 70112 - RNA, 90 nt, Artificial Sequence
  ATP synthase-coupling factor 6, mitochondrial (33-62)
aacaaggagcuggaccccauccagaaacucuucguggauaagauuagagaauacaaaagcaagaggcaaaccuccggcgggccugucgac

SEQ ID NO: 70113 - RNA, 33 nt, Artificial Sequence
  Eukaryotic translation initiation factor 3 subunit C-like protein (131-141)
aacaagaauaacgccaaagcucugagcacccuc

SEQ ID NO: 70114 - RNA, 51 nt, Artificial Sequence
  Heat shock 70 kDa protein 4 (753-769)
aacaagcagagccugaccauggaccccguggucaaauccaaggagaucgaa

SEQ ID NO: 70115 - RNA, 27 nt, Artificial Sequence
  Bifunctional glutamate/proline-tRNA ligase (1023-1031)
aaccuggccgacugguacagccaggug

SEQ ID NO: 70116 - RNA, 24 nt, Artificial Sequence
  Vimentin (177-184)
aaccuggccgaggacaucaugaga

SEQ ID NO: 70117 - RNA, 33 nt, Artificial Sequence
  Dystonin (208-218)
aaccuggccaaucucgagcacgcuuucuacgug

SEQ ID NO: 70118 - RNA, 27 nt, Artificial Sequence
  CMP-sialic acid transporter (111-119)
aaccuggacgccgcuguguaccagguc

SEQ ID NO: 70119 - RNA, 27 nt, Artificial Sequence
  Cysteine andine-rich protein 1 (43-51)
aaccuggacagcaccacaguggccguc

SEQ ID NO: 70120 - RNA, 30 nt, Artificial Sequence; identical to SEQ ID NO: 45893
  Phospholipase A1 member A (42-51)

SEQ ID NO: 70121 - RNA, 27 nt, Artificial Sequence
  Eukaryotic translation initiation factor 3 subunit L (162-170)
aaccuguucaauuacauccucaacgcc

SEQ ID NO: 70122 - RNA, 24 nt, Artificial Sequence
  Eukaryotic translation initiation factor 2-alpha kinase 4 (1314-1321)
aaccugggccucguguacaagguc

SEQ ID NO: 70123 - RNA, 27 nt, Artificial Sequence
  F-box/LRR-repeat protein 18 (261-269)
aaccugcacgccuuccucaucagcgug

SEQ ID NO: 70124 - RNA, 99 nt, Artificial Sequence
  Glia-derived nexin (344-376)
aaccugcacgugagccauauccuccagaaggccaaaauugaggucuccgaagacggcaccaaggcuucugcagccacaacugcgauacuuaucgcuaga

SEQ ID NO: 70125 - RNA, 102 nt, Artificial Sequence
  Glia-derived nexin (344-377)
aaccugcacgugagccauauccuccagaaggccaaaauugaggucuccgaagacggcaccaaggcuucugcagccacaacugcgauacuuaucgcuagauca

SEQ ID NO: 70126 - RNA, 27 nt, Artificial Sequence
  GPI ethanolamine phosphate transferase 3 (51-59)
aaccugaucaagcagcucaccagcgcc

SEQ ID NO: 70127 - RNA, 27 nt, Artificial Sequence
  Protein EFR3 homolog B (453-461)
aaccugaucagccagcucaccacagug

SEQ ID NO: 70128 - RNA, 30 nt, Artificial Sequence
  Protein FAM179B (401-410)
aaccugcucgacgauagcaauuucaaggug

SEQ ID NO: 70129 - RNA, 30 nt, Artificial Sequence; identical to SEQ ID NO: 45902
  FERM domain-containing protein 5 (46-55)

SEQ ID NO: 70130 - RNA, 27 nt, Artificial Sequence
  Plexin-B3 (1375-1383)
aaccugcucaauagcaagcuuuuccug

SEQ ID NO: 70131 - RNA, 27 nt, Artificial Sequence
  Vacuolar protein sorting-associated protein 53 homolog (176-184)
aaccugcuccagggcgugaugaauguc

SEQ ID NO: 70132 - RNA, 27 nt, Artificial Sequence
  Transcription factor SOX-6 (265-273)
aaccugcuccagcaacagauccaggug

SEQ ID NO: 70133 - RNA, 33 nt, Artificial Sequence
  Putative segment polarity protein dishevelled homolog DVL1P1 (257-267)
aaccugaauagcggcuccucugggaccucagac

SEQ ID NO: 70134 - RNA, 27 nt, Artificial Sequence
  Melanophilin (391-399)
aaccugcccaucuuccucccuagagug

SEQ ID NO: 70135 - RNA, 24 nt, Artificial Sequence
  CUB and sushi domain-containing protein 3 (2038-2045)
aaccugcccaucggcuucggggug

SEQ ID NO: 70136 - RNA, 27 nt, Artificial Sequence
  Krueppel-like factor 15 (273-281)
aaccugcccagcaaguucgugagaauc

SEQ ID NO: 70137 - RNA, 30 nt, Artificial Sequence
  Clathrin heavy chain 1 (795-804)
aaccugcagaaguacaucgagauuuaugug

SEQ ID NO: 70138 - RNA, 33 nt, Artificial Sequence
  Histone-lysine N-methyltransferase, H3 lysine-79 specific (241-251)
aaccugagcgacaucggcaccauuaugagagug

SEQ ID NO: 70139 - RNA, 27 nt, Artificial Sequence
  Talin-1 (583-591)
aaccugaccgagaugagcagaggcgug

SEQ ID NO: 70140 - RNA, 27 nt, Artificial Sequence
  Cytoplasmic dynein 2 heavy chain 1 (271-279)
aaccugugggaggaccccuacuaucuc

SEQ ID NO: 70141 - RNA, 27 nt, Artificial Sequence
  Receptor-type tyrosine-protein phosphatase kappa (420-428)
aaccuguggaauagcacccaccaugug

SEQ ID NO: 70142 - RNA, 30 nt, Artificial Sequence
  Contactin-associated protein-like 3B (1097-1106)
aacauggccgacggccagcugcaccaagug

SEQ ID NO: 70143 - RNA, 27 nt, Artificial Sequence
  Nucleolar pre-ribosomal-associated protein 1 (1538-1546)
aacauggacaaggugcccggcuucuac

SEQ ID NO: 70144 - RNA, 36 nt, Artificial Sequence
  Unconventional myosin-Va (131-142)
aacaugggcgacauggauccccacaucuucgccgug

SEQ ID NO: 70145 - RNA, 27 nt, Artificial Sequence
  Sodium-dependent proline transporter (134-142)
aacaugaucauugccuacgugcuguuc

SEQ ID NO: 70146 - RNA, 27 nt, Artificial Sequence
  Striatin-interacting protein 2 (728-736)
aacaugaagaccaugagcgccaucuac

SEQ ID NO: 70147 - RNA, 27 nt, Artificial Sequence
  Laminin subunit gamma-1 (71-79)
aacaugcugaagcagcuccaagaggcc

SEQ ID NO: 70148 - RNA, 27 nt, Artificial Sequence
  UDP-glucose:glycoprotein glucosyltransferase 2 (920-928)
aacaugagcgacuucaucaugaaggug

SEQ ID NO: 70149 - RNA, 27 nt, Artificial Sequence
  Lysine-tRNA ligase (423-431)
aacaugguggaggaacuggagaaggcc

SEQ ID NO: 70150 - RNA, 27 nt, Artificial Sequence
  Tetratricopeptide repeat protein 28 (1500-1508)
aacauggugggcaugcugcaccagguc

SEQ ID NO: 70151 - RNA, 30 nt, Artificial Sequence
  Sodium/potassium-transporting ATPase subunit alpha-3 (166-175)
aacauggugccccagcaagcccuggucauc

SEQ ID NO: 70152 - RNA, 27 nt, Artificial Sequence
  Inositol 1,4,5-trisphosphate receptor type 1 (2083-2091)
aacaaugccagcaagcugcuccuugcu

SEQ ID NO: 70153 - RNA, 21 nt, Artificial Sequence
  F-box only protein 25 (151-157)
aacaauauccuguacagauuc

SEQ ID NO: 70154 - RNA, 24 nt, Artificial Sequence
  Keratin, type II cytoskeletal 1b (325-332)
aacaauagaagccuggaccucgau

SEQ ID NO: 70155 - RNA, 48 nt, Artificial Sequence
  Filamin-A (2114-2129)
aaccccgccgaguucguggucaauaccagcaacgcuggcgcaggggcc

SEQ ID NO: 70156 - RNA, 51 nt, Artificial Sequence
  Filamin-A (2114-2130)
aaccccgccgaguucguggucaauaccagcaacgcuggcgcaggggcccug

SEQ ID NO: 70157 - RNA, 30 nt, Artificial Sequence
  Ras GTPase-activating-like protein IQGAP1 (1197-1206)
aaccccgccaucguggcuccugacgcauuc

SEQ ID NO: 70158 - RNA, 27 nt, Artificial Sequence
  Leucine-rich repeat serine/threonine-protein kinase 2 (1842-1850)
aaccccgaccagccuagacugaccauc

SEQ ID NO: 70159 - RNA, 45 nt, Artificial Sequence
  Calreticulin (296-310)
aaccccgaguacagcccugacccauccaucuaugccuacgauaau

SEQ ID NO: 70160 - RNA, 42 nt, Artificial Sequence
  Cytochrome c oxidase subunit 6A1, mitochondrial (73-86)
aacccccacgugaauccucugccaaccggcuacgaggacgaa

SEQ ID NO: 70161 - RNA, 27 nt, Artificial Sequence
  Pre-mRNA-splicing factor ATP-dependent RNA helicase PRP16 (832-840)
aaccccagaaucggcauggacgcccug

SEQ ID NO: 70162 - RNA, 54 nt, Artificial Sequence
  E3 ubiquitin-protein ligase UBR4 (202-219)
aaccccagaaccguggccagccagccuaucuccacacaaacucuggucgagggc

SEQ ID NO: 70163 - RNA, 27 nt, Artificial Sequence
  Angiomotin (27-35)
aaccccagcgagaauagaucccugcuc

SEQ ID NO: 70164 - RNA, 30 nt, Artificial Sequence
  E3 ubiquitin-protein ligase HERC2 (1771-1780)
aaccccagcggcccuucccuggggaccauc

SEQ ID NO: 70165 - RNA, 27 nt, Artificial Sequence
  Poly (ADP-ribose) polymerase 14 (87-95)
aaccccuacaauggcgggggaagagug

SEQ ID NO: 70166 - RNA, 24 nt, Artificial Sequence
  Ceramide synthase 2 (123-130)
aaccaggacagacccagccugcuc

SEQ ID NO: 70167 - RNA, 27 nt, Artificial Sequence
  Exosome complex exonuclease RRP44 (115-123)
aaccaggagaagcacuucuacaccuuu

SEQ ID NO: 70168 - RNA, 60 nt, Artificial Sequence
  Heterogeneous nuclear ribonucleoprotein A1-like 2 (148-167)
aaccagggcggguacggagguagcuccucuucaaguagcuauggcuccgggagaagguuc

SEQ ID NO: 70169 - RNA, 21 nt, Artificial Sequence
  Mid1-interacting protein 1 (8-14)
aaccagaagcacagccuguuc

SEQ ID NO: 70170 - RNA, 27 nt, Artificial Sequence
  Splicing factor U2AF 65 kDa subunit (348-356)
aaccagacccccgugacacugcaaguc

SEQ ID NO: 70171 - RNA, 21 nt, Artificial Sequence
  DNA polymerase epsilon catalytic subunit A (1795-1801)
aaccaggugaugcacuucuac

SEQ ID NO: 70172 - RNA, 30 nt, Artificial Sequence
  Ankyrin repeat domain-containing protein 26 (77-86)
aacagaaagcugauccccagggagaaucuc

SEQ ID NO: 70173 - RNA, 24 nt, Artificial Sequence
  Myosin-9 (710-717)
aacagaguggucuuccaggaguuu

SEQ ID NO: 70174 - RNA, 42 nt, Artificial Sequence
  Hemicentin-1 (685-698)
aacagcgccggcaccgacaagcagaauuccacacugagauac

SEQ ID NO: 70175 - RNA, 24 nt, Artificial Sequence
  Mitochondrial import inner membrane translocase subunit TIM50 (276-283)
aacagcgacgauagagugcugcuc

SEQ ID NO: 70176 - RNA, 36 nt, Artificial Sequence
  Cell adhesion molecule-related/down-regulated by oncogenes (944-955)
aacagccugggcuccgggggaaaugugggucccgcc

SEQ ID NO: 70177 - RNA, 30 nt, Artificial Sequence; identical to SEQ ID NO: 45950
  Protein phosphatase 1 regulatory subunit 12A (714-723)

SEQ ID NO: 70178 - RNA, 42 nt, Artificial Sequence
  Synaptotagmin-like protein 2 (277-290)
aacagcuccucuucaaguaccgacagcgagacacugagauac

SEQ ID NO: 70179 - RNA, 33 nt, Artificial Sequence
  ATP synthase subunit epsilon-like protein, mitochondrial (41-51)
aacagcgugaagaucgucaaaguuaagaaagag

SEQ ID NO: 70180 - RNA, 39 nt, Artificial Sequence
  Ankyrin-2 (1558-1570)
aacaccgagccccugcaggaaagaaucagccacuccuac

SEQ ID NO: 70181 - RNA, 27 nt, Artificial Sequence
  GRB2-associated-binding protein 1 (88-96)
aacaccaucgacagaauuuucuaccug

SEQ ID NO: 70182 - RNA, 33 nt, Artificial Sequence
  Microphthalmia-associated transcription factor (237-247)
aacacccugcccgugagcggcaaucucaucgac

SEQ ID NO: 70183 - RNA, 36 nt, Artificial Sequence
  Microphthalmia-associated transcription factor (90-101)
aacacccugcccgugagcggcaaucucaucgaccuu

SEQ ID NO: 70184 - RNA, 27 nt, Artificial Sequence
  Multidrug and toxin extrusion protein 1 (136-144)
aacacccagcacauccugcuccuuuuc

SEQ ID NO: 70185 - RNA, 30 nt, Artificial Sequence
  Hemicentin-1 (2932-2941)
aacacccagaucacagacauuggcagauac

SEQ ID NO: 70186 - RNA, 33 nt, Artificial Sequence
  Titin (6557-6567)
aacguggccggcgacgaugcuugcagcgggauc

SEQ ID NO: 70187 - RNA, 27 nt, Artificial Sequence
  Rho guanine nucleotide exchange factor 2 (401-409)
aacguggacgagggcaucuaccagcug

SEQ ID NO: 70188 - RNA, 27 nt, Artificial Sequence
  Hemicentin-1 (3845-3853)
aacguggaccagaaucaaaacagcuac

SEQ ID NO: 70189 - RNA, 27 nt, Artificial Sequence
  Serine/threonine-protein phosphatase PP1-beta catalytic subunit (7-15)
aacguggacagccugaucaccagacuc

SEQ ID NO: 70190 - RNA, 48 nt, Artificial Sequence
  Alpha-enolase (36-51)
aacgugggcgacgaggggggauucgcccccaauauccuggaaaacaag

SEQ ID NO: 70191 - RNA, 21 nt, Artificial Sequence
  tRNA (adenine(58)-N(1))-methyltransferase non-catalytic subunit TRM6 (56-62)
aacgugaucggccacagcuac

SEQ ID NO: 70192 - RNA, 81 nt, Artificial Sequence
  Heat shock-related 70 kDa protein 2 (197-223)
aacgugcugaucuucgaccucggcgggggaaccuuugaugucagcauucuuacaauagaggacgguaucuucgaaguuaag

SEQ ID NO: 70193 - RNA, 48 nt, Artificial Sequence
  Heat shock 70 kDa protein 1-like (170-185)
aacgugcugagaaucauuaaugagcccaccgccgcugcaauagccuac

SEQ ID NO: 70194 - RNA, 51 nt, Artificial Sequence
  78 kDa glucose-regulated protein (176-192)
aacgugaugagaaucauuaaugagcccaccgccgcugcaauagccuacggc

SEQ ID NO: 70195 - RNA, 45 nt, Artificial Sequence
  Guanine nucleotide-binding protein G(i) subunit alpha-1 (331-345)
aacgugcaguucgucuuugacgccguuaccgaugugaucauuaag

SEQ ID NO: 70196 - RNA, 24 nt, Artificial Sequence
  Nuclease-sensitive element-binding protein 1 (67-74)
aacgugagaaauggcuacggguuc

SEQ ID NO: 70197 - RNA, 27 nt, Artificial Sequence
  Receptor-type tyrosine-protein phosphatase kappa (1423-1431)
aacguggucgacguuuuccacgccgug

SEQ ID NO: 70198 - RNA, 27 nt, Artificial Sequence
  Fidgetin-like protein 1 (81-89)
aacuacgccgagaauauccugacccuc

SEQ ID NO: 70199 - RNA, 21 nt, Artificial Sequence
  DNA-directed RNA polymerases I, II, and III subunit RPABC5 (61-67)
aacuacgccccccuggagaag

SEQ ID NO: 70200 - RNA, 27 nt, Artificial Sequence
  Melanoma-associated antigen 10 (167-175)
aacuacgaggaccacuucccccugcuc

SEQ ID NO: 70201 - RNA, 33 nt, Artificial Sequence; identical to SEQ ID NO: 45974
  Protein phosphatase Slingshot homolog 1 (196-206)

SEQ ID NO: 70202 - RNA, 27 nt, Artificial Sequence
  Transformation/transcription domain-associated protein (1707-1715)
aacuacggcgacaucgagcugcucuuc

SEQ ID NO: 70203 - RNA, 27 nt, Artificial Sequence
  Isocitrate dehydrogenase (NAD) subunit gamma, mitochondrial (298-306)
aacuacggccacguguaugccgucuuc

SEQ ID NO: 70204 - RNA, 27 nt, Artificial Sequence
  Lathosterol oxidase (239-247)
aacuacggccaguauuucacccugugg

SEQ ID NO: 70205 - RNA, 27 nt, Artificial Sequence
  Beta-Ala-His dipeptidase (489-497)
aacuacaucgagggcaccaagcuguuc

SEQ ID NO: 70206 - RNA, 27 nt, Artificial Sequence
  Procollagen-lysine,2-oxoglutarate 5-dioxygenase 1 (255-263)
aacuacauccccagauucuggaccuuu

SEQ ID NO: 70207 - RNA, 27 nt, Artificial Sequence
  Probable E3 ubiquitin-protein ligase HERC3 (467-475)
aacuacaucaccgccgcucugaagcuc

SEQ ID NO: 70208 - RNA, 21 nt, Artificial Sequence
  Heat shock protein HSP 90-beta (351-357)
aacuacaagaaauucuaugag

SEQ ID NO: 70209 - RNA, 27 nt, Artificial Sequence
  Heat shock protein HSP 90-beta (351-359)
aacuacaagaaauucuaugaggccuuu

SEQ ID NO: 70210 - RNA, 33 nt, Artificial Sequence
  Muskelin (29-39)
aacuaccccccucaguaucugauccucaagcuu

SEQ ID NO: 70211 - RNA, 27 nt, Artificial Sequence
  Pleckstrin homology domain-containing family G member 2 (150-158)
aacuaccccagcucccuggcccuccuu

SEQ ID NO: 70212 - RNA, 33 nt, Artificial Sequence; identical to SEQ ID NO: 45985
  DNA polymerase zeta catalytic subunit (1024-1034)

SEQ ID NO: 70213 - RNA, 27 nt, Artificial Sequence
  Transmembraneoprotein NMB (275-283)
aacuacagcaccaucaauuauaagugg

SEQ ID NO: 70214 - RNA, 27 nt, Artificial Sequence
  1,2-dihydroxy-3-keto-5-methylthiopentene dioxygenase (141-149)
aacuacaccaaggccaugagacuguuc

SEQ ID NO: 70215 - RNA, 30 nt, Artificial Sequence
  HLA class II histocompatibility antigen, DR alpha chain (103-112)
aacuacacccccaucacaaaugacaaguuc

SEQ ID NO: 70216 - RNA, 27 nt, Artificial Sequence
  DNA-dependent protein kinase catalytic subunit (289-297)
aacuacgugagccuguucgagguccuc

SEQ ID NO: 70217 - RNA, 27 nt, Artificial Sequence
  Polycystin-1 (3-11)
cccgccgcuccugcaagacuggcccuc

SEQ ID NO: 70218 - RNA, 24 nt, Artificial Sequence
  Exportin-T (609-616)
cccgccgagagaaagcaggcucug

SEQ ID NO: 70219 - RNA, 36 nt, Artificial Sequence
  Collagen alpha-1(V) chain (1145-1156)
cccgccggcccuguggggccaccgggagaggacggu

SEQ ID NO: 70220 - RNA, 24 nt, Artificial Sequence
  tRNA pseudouridine synthase-like 1 (273-280)
cccgcccacggccuguuccucaag

SEQ ID NO: 70221 - RNA, 24 nt, Artificial Sequence
  Sushi repeat-containing protein SRPX (4-11)
cccgcccacagaccugcucugcuc

SEQ ID NO: 70222 - RNA, 39 nt, Artificial Sequence
  Syntenin-1 (29-41)
cccgccauccugagcgaggcuuccgcaccuauuccacac

SEQ ID NO: 70223 - RNA, 24 nt, Artificial Sequence
  Acetolactate synthase-like protein (225-232)
cccgccaagccuccaaaaggccug

SEQ ID NO: 70224 - RNA, 27 nt, Artificial Sequence
  Calmodulin-regulated spectrin-associated protein 3 (958-966)
cccgccccugcugcaagagccccagcg

SEQ ID NO: 70225 - RNA, 27 nt, Artificial Sequence
  Tissue factor pathway inhibitor 2 (3-11)
cccgccagaccucugggccucagcauc

SEQ ID NO: 70226 - RNA, 21 nt, Artificial Sequence
  Phosphoinositide 3-kinase regulatory subunit 5 (495-501)
cccgccagcagaccucagagg

SEQ ID NO: 70227 - RNA, 27 nt, Artificial Sequence
  m7GpppX diphosphatase (134-142)
cccgccaccgagaagcaccugcagaaa

SEQ ID NO: 70228 - RNA, 36 nt, Artificial Sequence
  Nardilysin (738-749)
cccgccuacgaggcugacguggcacagcuggaauau

SEQ ID NO: 70229 - RNA, 27 nt, Artificial Sequence
  Lysosome-associated membraneoprotein 1 (250-258)
cccgacgccagagauccugcuuucaag

SEQ ID NO: 70230 - RNA, 21 nt, Artificial Sequence
  Uncharacterized protein C14orf119 (123-129)
cccgacuucguggccaaguuu

SEQ ID NO: 70231 - RNA, 24 nt, Artificial Sequence
  RNA-binding protein 12B (29-36)
cccgacggcggggugcacaucauu

SEQ ID NO: 70232 - RNA, 21 nt, Artificial Sequence
  Thyroid transcription factor 1-associated protein 26 (90-96)
cccgacaaccugaagcaccuc

SEQ ID NO: 70233 - RNA, 24 nt, Artificial Sequence
  Tubulin beta-6 chain (95-102)
cccgacagaaucaugaacaccuuc

SEQ ID NO: 70234 - RNA, 36 nt, Artificial Sequence
  SH3 and multiple ankyrin repeat domains protein 1 (980-991)
cccgacaccccugccccagcuacaccgcugcccccu

SEQ ID NO: 70235 - RNA, 30 nt, Artificial Sequence
  Copper-transporting ATPase 1 (1234-1243)
cccgaggccgaacuggcuauccacauucuc

SEQ ID NO: 70236 - RNA, 45 nt, Artificial Sequence
  Putative endoplasmin-like protein (220-234)
cccgaguucgacggcaagagauuucagaacguggccaaagaaggg

SEQ ID NO: 70237 - RNA, 33 nt, Artificial Sequence
  Fatty acid synthase (753-763)
cccgagcacgccgugguccuggaaaucgcuccu

SEQ ID NO: 70238 - RNA, 24 nt, Artificial Sequence
  Proteasome-associated protein ECM29 homolog (684-691)
cccgagaagcuggccaccaaauuc

SEQ ID NO: 70239 - RNA, 21 nt, Artificial Sequence
  Serine/threonine-protein kinase ULK3 (110-116)
cccgagaagguggccagaguc

SEQ ID NO: 70240 - RNA, 33 nt, Artificial Sequence
  Alsin (1431-1441)
cccgagcugccugaagagggcagcaccauccca

SEQ ID NO: 70241 - RNA, 30 nt, Artificial Sequence
  Serine/arginine repetitive matrix protein 2 (361-370)
cccgagccuccagccccgaccccccugcuc

SEQ ID NO: 70242 - RNA, 36 nt, Artificial Sequence
  Homeobox protein SIX5 (88-99)
cccgagcagguggccugcgucugugaagcucugcuc

SEQ ID NO: 70243 - RNA, 30 nt, Artificial Sequence
  Putative exonuclease GOR (33-42)
cccgagagaccuggcggggccgugcuguuc

SEQ ID NO: 70244 - RNA, 72 nt, Artificial Sequence
  Neutral alpha-glucosidase AB (824-847)
cccgagaccagcgugcugguccucagaaagccuggcaucaacguugccuccgacuggucuauucaccuuagg

SEQ ID NO: 70245 - RNA, 21 nt, Artificial Sequence
  Coatomer subunit alpha (635-641)
cccgagguggcccugcacuuc

SEQ ID NO: 70246 - RNA, 27 nt, Artificial Sequence
  Melanocyte protein PMEL (57-65)
cccgaguggaccgaagcccagagacug

SEQ ID NO: 70247 - RNA, 42 nt, Artificial Sequence
  Calreticulin (297-310)
cccgaguacagcccugacccauccaucuaugccuacgauaac

SEQ ID NO: 70248 - RNA, 24 nt, Artificial Sequence
  Tyrosine-protein phosphatase non-receptor type 11 (284-291)
cccuucgaccacaccagagugguc

SEQ ID NO: 70249 - RNA, 24 nt, Artificial Sequence
  Polypyrimidine tract-binding protein 2 (92-99)
cccuucggcaaggugaccaacauc

SEQ ID NO: 70250 - RNA, 24 nt, Artificial Sequence
  Polypyrimidine tract-binding protein 3 (124-131)
cccuucggcaaggugaccaaccug

SEQ ID NO: 70251 - RNA, 30 nt, Artificial Sequence
  Uncharacterized protein KIAA0556 (546-555)
cccuuccacccuccacugcagcucuuuuuc

SEQ ID NO: 70252 - RNA, 30 nt, Artificial Sequence
  Transmembrane and TPR repeat-containing protein 1 (393-402)
cccuucaucccugccagcaaccuguuuuuc

SEQ ID NO: 70253 - RNA, 27 nt, Artificial Sequence
  Glycine dehydrogenase (decarboxylating), mitochondrial (778-786)
cccuuccugccuaaccacccagugauc

SEQ ID NO: 70254 - RNA, 36 nt, Artificial Sequence
  Cytochrome c oxidase subunit 7C, mitochondrial (52-63)
cccuuccugguggucagacaccagcuccuuaagacc

SEQ ID NO: 70255 - RNA, 21 nt, Artificial Sequence
  Interferon-induced 35 kDa protein (53-59)
cccuucagcgugccuaagauc

SEQ ID NO: 70256 - RNA, 27 nt, Artificial Sequence
  U2 small nuclear ribonucleoprotein B'' (73-81)
cccuucuacggcaagccuaugagaauc

SEQ ID NO: 70257 - RNA, 39 nt, Artificial Sequence
  SH2 domain-containing protein 3A (404-416)
cccggcgccgcuggggaccugccuggacucgcagccgug

SEQ ID NO: 70258 - RNA, 30 nt, Artificial Sequence
  NADH dehydrogenase (ubiquinone) 1 beta subcomplex subunit 7 (126-135)
cccggcgagguggacccuaaggucgcccug

SEQ ID NO: 70259 - RNA, 48 nt, Artificial Sequence
  Heat shock cognate 71 kDa protein (622-637)
cccggcggguucccuggagguggcgccccaccgagcgggggagcuucc

SEQ ID NO: 70260 - RNA, 39 nt, Artificial Sequence
  Shadow of prion protein (108-120)
cccggcgggaacggaaccgguccuggcaucuacagcuau

SEQ ID NO: 70261 - RNA, 24 nt, Artificial Sequence
  HLA class II histocompatibility antigen, DR beta 5 chain (7-14)
cccggcgggagcuacauggccaag

SEQ ID NO: 70262 - RNA, 24 nt, Artificial Sequence
  BAG family molecular chaperone regulator 3 (334-341)
cccggccacaucccuauucaggug

SEQ ID NO: 70263 - RNA, 54 nt, Artificial Sequence
  Collagen alpha-5(IV) chain (1035-1052)
cccggcccucaggggguggagggaccaccgggucccagcggcgucccugggcaa

SEQ ID NO: 70264 - RNA, 24 nt, Artificial Sequence
  Adenomatous polyposis coli protein 2 (1191-1198)
cccggcccuagagccaccccaagg

SEQ ID NO: 70265 - RNA, 27 nt, Artificial Sequence
  Mucin-5B (364-372)
cccggcaccgccccuccaccgaaggug

SEQ ID NO: 70266 - RNA, 60 nt, Artificial Sequence
  Elastin (116-135)
cccggcguggggggacugggugucagcgccggcgcuguugugccucagccaggggcagga

SEQ ID NO: 70267 - RNA, 21 nt, Artificial Sequence
  Mitochondrial import inner membrane translocase subunit TIM50 (216-222)
ccccacggcuucaucagcuac

SEQ ID NO: 70268 - RNA, 18 nt, Artificial Sequence
  BolA-like protein 2 (65-70)
ccccacauccaugccuuc

SEQ ID NO: 70269 - RNA, 24 nt, Artificial Sequence
  ATP synthase subunit d, mitochondrial (130-137)
ccccaccagccuaucgagaaccug

SEQ ID NO: 70270 - RNA, 24 nt, Artificial Sequence
  Dolichyl-diphosphooligosaccharide-proteinosyltransferase subunit 2 (292-299)
ccccaccagaccuucgugagacug

SEQ ID NO: 70271 - RNA, 60 nt, Artificial Sequence
  Syndecan-3 (6-25)
ccccacagagccggcgcugcacauggggccggagcgggugcuggcgccgcagccgggccu

SEQ ID NO: 70272 - RNA, 39 nt, Artificial Sequence
  Cytochrome c oxidase subunit 6A1, mitochondrial (74-86)
ccccacgugaacccucugccaaccggcuacgaggacgaa

SEQ ID NO: 70273 - RNA, 21 nt, Artificial Sequence
  BAG family molecular chaperone regulator 3 (292-298)
cccaucagagugcacaccguc

SEQ ID NO: 70274 - RNA, 24 nt, Artificial Sequence
  Major facilitator superfamily domain-containing protein 12 (309-316)
cccaagaaauucaucgccaccauu

SEQ ID NO: 70275 - RNA, 63 nt, Artificial Sequence
  MICOS complex subunit MIC27 (248-268)
cccaagcugauggaccacggccagagccauccugaggauaucgacauguacuccaccagaucu

SEQ ID NO: 70276 - RNA, 21 nt, Artificial Sequence
  40S ribosomal protein S26 (65-71)
cccaagcuguacgugaaacuc

SEQ ID NO: 70277 - RNA, 24 nt, Artificial Sequence
  26S proteasome non-ATPase regulatory subunit 6 (12-19)
cccaagaacccugaccugagaauc

SEQ ID NO: 70278 - RNA, 24 nt, Artificial Sequence
  Ran-binding protein 9 (351-358)
cccaagcagccuccacuggcccuc

SEQ ID NO: 70279 - RNA, 24 nt, Artificial Sequence
  High mobility group protein B1 (95-102)
cccaagagaccuccaagcgccuuc

SEQ ID NO: 70280 - RNA, 36 nt, Artificial Sequence
  Ras-associated and pleckstrin homology domains-containing protein 1 (1085-1096)
cccaagguggccgucguuaacccucagccacaacag

SEQ ID NO: 70281 - RNA, 42 nt, Artificial Sequence
  Annexin A2 (211-224)
cccaaguggaucagcauuaugaccgagagauccgugccucac

SEQ ID NO: 70282 - RNA, 24 nt, Artificial Sequence
  Guanine nucleotide-binding protein-like 3 (296-303)
ccccuggacaagcagaucaccauu

SEQ ID NO: 70283 - RNA, 30 nt, Artificial Sequence
  MAX gene-associated protein (2401-2410)
ccccuguucagcggcccuguggucgccguu

SEQ ID NO: 70284 - RNA, 21 nt, Artificial Sequence
  A-kinase anchor protein 6 (596-602)
ccccugcucagcaagcacaaa

SEQ ID NO: 70285 - RNA, 21 nt, Artificial Sequence
  Ubiquitin carboxyl-terminal hydrolase 11 (444-450)
ccccugccuaucagccacaag

SEQ ID NO: 70286 - RNA, 30 nt, Artificial Sequence
  Protein transport protein Sec23B (244-253)
ccccugagaagcaccggcguggcccucucc

SEQ ID NO: 70287 - RNA, 21 nt, Artificial Sequence
  Muskelin (629-635)
ccccugagcgcccucaaguac

SEQ ID NO: 70288 - RNA, 24 nt, Artificial Sequence
  X-ray repair cross-complementing protein 5 (529-536)
ccccugagcaagaucaaaacccuc

SEQ ID NO: 70289 - RNA, 27 nt, Artificial Sequence
  HLA class I histocompatibility antigen, B-15 alpha chain (293-301)
ccccugacccucagaugggagccuagc

SEQ ID NO: 70290 - RNA, 63 nt, Artificial Sequence
  60 kDa heat shock protein, mitochondrial (154-174)
ccccuggugaucauugccgaggacgucgauggcgaagcucucagcacccuuguucugaacaga

SEQ ID NO: 70291 - RNA, 27 nt, Artificial Sequence
  Protein DBF4 homolog A (45-53)
ccccuguggggcaagguguucuaccuc

SEQ ID NO: 70292 - RNA, 27 nt, Artificial Sequence
  Extracellular matrix protein FRAS1 (1653-1661)
cccauggccaccggcgacacauucacu

SEQ ID NO: 70293 - RNA, 24 nt, Artificial Sequence
  Alpha/beta hydrolase domain-containing protein 14B (204-211)
cccaaccacagagugcugaucaug

SEQ ID NO: 70294 - RNA, 24 nt, Artificial Sequence
  Ubiquitin-associated protein 2-like (269-276)
cccccugccccauucaugcacauc

SEQ ID NO: 70295 - RNA, 27 nt, Artificial Sequence
  Transforming acidic coiled-coil-containing protein 2 (1969-1977)
cccccugccccaccgcccccuccaccc

SEQ ID NO: 70296 - RNA, 30 nt, Artificial Sequence
  Rho GTPase-activating protein 33 (668-677)
cccccugccgugcuggagcuccuuggcgcu

SEQ ID NO: 70297 - RNA, 48 nt, Artificial Sequence
  Transmembrane protein 238 (14-29)
cccccuggcgccccaagcgcuccggcagccgcgcccgcuccugccgca

SEQ ID NO: 70298 - RNA, 36 nt, Artificial Sequence
  Homeobox protein SIX5 (441-452)
cccccuggcccagugccggccgucgcugcaccccag

SEQ ID NO: 70299 - RNA, 36 nt, Artificial Sequence
  Collagen alpha-1(VII) chain (2384-2395)
cccccuggcgugaagggggaccugggacucccaggu

SEQ ID NO: 70300 - RNA, 27 nt, Artificial Sequence
  Mitochondrial fission regulator 1 (151-159)
cccccucacccaccgcccccuccaccc

SEQ ID NO: 70301 - RNA, 21 nt, Artificial Sequence
  Sentrin-specific protease 6 (157-163)
cccccucacgugcagaagguc

SEQ ID NO: 70302 - RNA, 30 nt, Artificial Sequence
  CCR4-NOT transcription complex subunit 1 (574-583)
cccccuaucaccacaacuacgaccagcaca

SEQ ID NO: 70303 - RNA, 21 nt, Artificial Sequence
  Cyclin E variant ex7del (21-27)
cccccuaagcugcaccaguuc

SEQ ID NO: 70304 - RNA, 27 nt, Artificial Sequence
  Drebrin (365-373)
cccccucugccaccgcccccuccaccc

SEQ ID NO: 70305 - RNA, 42 nt, Artificial Sequence
  Tuberin (1264-1277)
cccccucugccaagaagcaacaccguggccuccuucucuuca

SEQ ID NO: 70306 - RNA, 27 nt, Artificial Sequence
  Multiple epidermal growth factor-like domains protein 8 (2528-2536)
cccccuccagccccgcccccuccaccc

SEQ ID NO: 70307 - RNA, 27 nt, Artificial Sequence
  Shootin-1 (299-307)
cccccuccacugccgcccccuccaccc

SEQ ID NO: 70308 - RNA, 39 nt, Artificial Sequence
  Serine/threonine-protein kinase WNK2 (136-148)
cccccuccaagcgacaugggcaccguggggggacaggcc

SEQ ID NO: 70309 - RNA, 42 nt, Artificial Sequence
  Retinoic acid-induced protein 1 (1033-1046)
cccccucagggccaaauggagggggccggagcuccagguaga

SEQ ID NO: 70310 - RNA, 27 nt, Artificial Sequence
  Retrotransposon-derived protein PEG10 (765-773)
cccccucagccaccgcccccuccaccc

SEQ ID NO: 70311 - RNA, 27 nt, Artificial Sequence
  Acrosin (110-118)
cccccuagcccaccgcccccuccaccc

SEQ ID NO: 70312 - RNA, 27 nt, Artificial Sequence
  Transcription factor SOX-9 (356-364)
ccccaggccccuccacaaccgcaggcu

SEQ ID NO: 70313 - RNA, 21 nt, Artificial Sequence
  Protein transport protein Sec23B (562-568)
ccccaguucauguuucaccug

SEQ ID NO: 70314 - RNA, 27 nt, Artificial Sequence
  Squalene monooxygenase (366-374)
ccccagaucccugaccaccugaaggag

SEQ ID NO: 70315 - RNA, 33 nt, Artificial Sequence
  Histone-lysine N-methyltransferase 2C (2512-2522)
ccccagcugagaaggagcguguccgucgacaug

SEQ ID NO: 70316 - RNA, 27 nt, Artificial Sequence
  Disintegrin and metalloproteinase domain-containing protein 18 (67-75)
ccccagaacuuccugguguacaccuau

SEQ ID NO: 70317 - RNA, 27 nt, Artificial Sequence
  Retrotransposon-derived protein PEG10 (766-774)
ccccagccuccaccgcccccuccaccc

SEQ ID NO: 70318 - RNA, 39 nt, Artificial Sequence
  Serum albumin (440-452)
ccccaggugagcaccccuacacuggucgagguuuccaga

SEQ ID NO: 70319 - RNA, 24 nt, Artificial Sequence
  Neural Wiskott-Aldrich syndrome protein (83-90)
cccagaggcuacuuccacaccuuu

SEQ ID NO: 70320 - RNA, 30 nt, Artificial Sequence
  60S ribosomal protein L13 (48-57)
cccagaccugccagcggcccaaucaggccg

SEQ ID NO: 70321 - RNA, 24 nt, Artificial Sequence
  Histone H2A deubiquitinase MYSM1 (447-454)
cccagaccuaccaagagcuccuuc

SEQ ID NO: 70322 - RNA, 24 nt, Artificial Sequence
  ATP-dependent RNA helicase DDX24 (200-207)
cccagaccugugcugagggcccuc

SEQ ID NO: 70323 - RNA, 24 nt, Artificial Sequence
  Splicing factor 3B subunit 3 (431-438)
cccagaagcucccugagggugcuc

SEQ ID NO: 70324 - RNA, 24 nt, Artificial Sequence
  Ankyrin repeat and KH domain-containing protein 1 (749-756)
cccagagugccuacccacacacug

SEQ ID NO: 70325 - RNA, 42 nt, Artificial Sequence
  AT-rich interactive domain-containing protein 1A (279-292)
cccagcgccgcuggcgggggaaccccucagccaacagcaacu

SEQ ID NO: 70326 - RNA, 27 nt, Artificial Sequence
  Large proline-rich protein BAG6 (53-61)
cccagcgagaagcagagacugaucuac

SEQ ID NO: 70327 - RNA, 33 nt, Artificial Sequence
  Ankyrin-2 (1035-1045)
cccagcggcgcccaguuccuggggccugugauc

SEQ ID NO: 70328 - RNA, 24 nt, Artificial Sequence
  Eukaryotic translation initiation factor 3 subunit C-like protein (204-211)
cccagcggcgaguccagaaaguuc

SEQ ID NO: 70329 - RNA, 27 nt, Artificial Sequence
  BAI1-associated protein 3 (124-132)
cccagccugggccucagagcccuugcu

SEQ ID NO: 70330 - RNA, 84 nt, Artificial Sequence
  Attractin (1008-1035)
cccagcaacaccggcaaggggaaaugcaucgagggauccuacaaggguccugugaaaaugccaucucaggccccgacaggcaau

SEQ ID NO: 70331 - RNA, 54 nt, Artificial Sequence
  Zinc finger protein 469 (879-896)
cccagcuccggccacccucugaagucuaaagccggggugaccccagagucaaag

SEQ ID NO: 70332 - RNA, 72 nt, Artificial Sequence
  Serine/threonine-protein kinase WNK1 (1547-1570)
cccagcuccucuucaaguccuggcgccggggugagcuccuacaucucucagccaggaggucugcacccgcuc

SEQ ID NO: 70333 - RNA, 36 nt, Artificial Sequence
  Fibronectin isoform 6 (769-780)
cccagcaccgccacauccgugaacaucccugaccug

SEQ ID NO: 70334 - RNA, 21 nt, Artificial Sequence
  Transcription factor HES-1 (104-110)
cccagcgugcugggcaaguac

SEQ ID NO: 70335 - RNA, 24 nt, Artificial Sequence
  Basement membrane-specific heparan sulfate proteoglycan core protein (2626-2633)
cccagcguguccccuccaaucaga

SEQ ID NO: 70336 - RNA, 27 nt, Artificial Sequence
  Serine/threonine-protein kinase ICK (273-281)
cccaccgccagccaggcucugagauac

SEQ ID NO: 70337 - RNA, 27 nt, Artificial Sequence
  Myotubularin-related protein 14 (360-368)
cccaccgagauccuguaccucacagug

SEQ ID NO: 70338 - RNA, 30 nt, Artificial Sequence
  Nicastrin (540-549)
cccaccaacacaacuuacgugguccaguau

SEQ ID NO: 70339 - RNA, 21 nt, Artificial Sequence
  Sorting nexin-5 (259-265)
cccaccgugaucaagaaauac

SEQ ID NO: 70340 - RNA, 30 nt, Artificial Sequence
  Doublesex- and mab-3-related transcription factor A2 (25-34)
cccguggccagcgucgcuuccguugcagcc

SEQ ID NO: 70341 - RNA, 27 nt, Artificial Sequence
  UPF0609 protein C4orf27 (230-238)
cccguggacaagaacgaugucggcuac

SEQ ID NO: 70342 - RNA, 27 nt, Artificial Sequence
  Hephaestin (425-433)
cccguggaccugcucaccggcaagguc

SEQ ID NO: 70343 - RNA, 33 nt, Artificial Sequence
  Single-stranded DNA-binding protein 3 (128-138)
cccgugccuccaggcgggagcagauccaacuuc

SEQ ID NO: 70344 - RNA, 27 nt, Artificial Sequence
  Enolase-like protein ENO4 (194-202)
cccgugccuccaccgcccccuccaccc

SEQ ID NO: 70345 - RNA, 27 nt, Artificial Sequence
  Obscurin (6294-6302)
cccguggucccuacccuguacguuaca

SEQ ID NO: 70346 - RNA, 24 nt, Artificial Sequence
  Matrin-3 (231-238)
cccuacggcaagaucaaaaacuau

SEQ ID NO: 70347 - RNA, 30 nt, Artificial Sequence
  Alpha-actinin-4 (178-187)
cccuacaagaacgugaauguccagaacuuc

SEQ ID NO: 70348 - RNA, 27 nt, Artificial Sequence
  Dedicator of cytokinesis protein 7 (627-635)
cccuaccuggacaaguucuuugcccuc

SEQ ID NO: 70349 - RNA, 27 nt, Artificial Sequence
  Dedicator of cytokinesis protein 6 (722-730)
cccuaccuggacaaguucuuuacccuc

SEQ ID NO: 70350 - RNA, 27 nt, Artificial Sequence
  Eukaryotic peptide chain release factor GTP-binding subunit ERF3A (285-293)
cccuaccuggacaaccucccuaauuuc

SEQ ID NO: 70351 - RNA, 27 nt, Artificial Sequence
  Melanoma antigen preferentially expressed in tumors (254-262)
cccuaccugggccagaugaucaaccuc

SEQ ID NO: 70352 - RNA, 27 nt, Artificial Sequence
  Elongation of very long chain fatty acids protein 5 (194-202)
cccuaccugugguggaagaaauauauc

SEQ ID NO: 70353 - RNA, 33 nt, Artificial Sequence; identical to SEQ ID NO: 46126
  Tubulin beta-6 chain (117-127)

SEQ ID NO: 70354 - RNA, 24 nt, Artificial Sequence
  LYR motif-containing protein 1 (80-87)
cccuacccuagaccaauccaccug

SEQ ID NO: 70355 - RNA, 27 nt, Artificial Sequence
  Cubilin (2661-2669)
cccuacagccagguguggauccacuuc

SEQ ID NO: 70356 - RNA, 36 nt, Artificial Sequence
  Pumilio homolog 1 (440-451)
cccuacaccgccggccuggcugcagccgcgacacuc

SEQ ID NO: 70357 - RNA, 27 nt, Artificial Sequence
  Serine/threonine-protein kinase Nek6 (236-244)
cccuacuauaugagcccugagagaauc

SEQ ID NO: 70358 - RNA, 24 nt, Artificial Sequence
  Progestin and adipoQ receptor family member 4 (113-120)
caggccgcugcaagacugcucgug

SEQ ID NO: 70359 - RNA, 48 nt, Artificial Sequence
  HLA class I histocompatibility antigen, B-15 alpha chain (346-361)
caggccgcuagcuccgacucugcacaaggcucagaugugagucugacc

SEQ ID NO: 70360 - RNA, 60 nt, Artificial Sequence
  HLA class I histocompatibility antigen, A-23 alpha chain (346-365)
caggccgcuagcuccgacucugcacaaggcucagaugugagucugaccgccugcaagguc

SEQ ID NO: 70361 - RNA, 27 nt, Artificial Sequence
  Nuclear distribution protein nudE-like 1 (66-74)
caggccgacaaccaaagacugaaguac

SEQ ID NO: 70362 - RNA, 42 nt, Artificial Sequence
  Glycogenin-1 (2-15)
caggccuucgugacccugacaacuaacgacgcuuacgcaaag

SEQ ID NO: 70363 - RNA, 39 nt, Artificial Sequence
  CREB-binding protein (405-417)
caggccauccugggcagccccgcuuccgggauucaaaac

SEQ ID NO: 70364 - RNA, 30 nt, Artificial Sequence
  Scavenger receptor cysteine-rich type 1 protein M160 (412-421)
caggcccugguggucugcaagcaacucggc

SEQ ID NO: 70365 - RNA, 27 nt, Artificial Sequence
  Myelin basic protein (108-116)
caggacgagaaccccgugguccacuuc

SEQ ID NO: 70366 - RNA, 21 nt, Artificial Sequence
  Clathrin heavy chain 1 (723-729)
caggaccccgaugugcacuuc

SEQ ID NO: 70367 - RNA, 27 nt, Artificial Sequence
  Fatty acid synthase (1595-1603)
caggacagccugcucggcauggaguuc

SEQ ID NO: 70368 - RNA, 27 nt, Artificial Sequence
  Stathmin-3 (88-96)
caggaggcccaagugcugaagcagcuc

SEQ ID NO: 70369 - RNA, 33 nt, Artificial Sequence
  Formin-1 (1099-1109)
caggaggacgaacuggugaagaucagaaaauac

SEQ ID NO: 70370 - RNA, 27 nt, Artificial Sequence
  WD repeat-containing protein 26 (508-516)
caggaggaccaccccaucaugagcuuc

SEQ ID NO: 70371 - RNA, 33 nt, Artificial Sequence
  Large proline-rich protein BAG6 (1111-1121)
caggaggaccccaacuacagcccucaaagauuc

SEQ ID NO: 70372 - RNA, 27 nt, Artificial Sequence
  Vigilin (1012-1020)
caggaggacagagcccugaggagcuuc

SEQ ID NO: 70373 - RNA, 36 nt, Artificial Sequence
  Nestin (502-513)
caggaggaagagggcagcgcccugaagaccuccugg

SEQ ID NO: 70374 - RNA, 27 nt, Artificial Sequence
  DNA (cytosine-5)-methyltransferase 3A (426-434)
caggaguucgaccccccuaagguguac

SEQ ID NO: 70375 - RNA, 30 nt, Artificial Sequence; identical to SEQ ID NO: 46148
  AT-rich interactive domain-containing protein 1B (1797-1806)

SEQ ID NO: 70376 - RNA, 27 nt, Artificial Sequence
  Hemicentin-1 (1703-1711)
caggagaucgacagaggccaauacauu

SEQ ID NO: 70377 - RNA, 21 nt, Artificial Sequence
  Annexin A2 (141-147)
caggagaucaacagaguguac

SEQ ID NO: 70378 - RNA, 30 nt, Artificial Sequence
  Mitogen-activated protein kinase kinase kinase kinase 5 (802-811)
caggagaucagcgacgaaaccagaguguuc

SEQ ID NO: 70379 - RNA, 27 nt, Artificial Sequence
  Serine-protein kinase ATM (95-103)
caggagaucagcucccuggugaaguac

SEQ ID NO: 70380 - RNA, 39 nt, Artificial Sequence
  Desmoglein-2 (903-915)
caggagaucgugaccgaaagaagcgucuccucuaggcaa

SEQ ID NO: 70381 - RNA, 30 nt, Artificial Sequence
  Synemin (16-25)
caggagcugaacgccagacucuacgacuau

SEQ ID NO: 70382 - RNA, 36 nt, Artificial Sequence
  Nestin (337-348)
caggagcugccccaaagcgccgacgugcagagaugg

SEQ ID NO: 70383 - RNA, 27 nt, Artificial Sequence
  Receptor-interacting serine/threonine-protein kinase 4 (597-605)
caggagaacaucgugagaauucugcuc

SEQ ID NO: 70384 - RNA, 27 nt, Artificial Sequence
  TSC22 domain family protein 1 (93-101)
caggagaacaaucugcucaagacccuu

SEQ ID NO: 70385 - RNA, 30 nt, Artificial Sequence
  Protein flightless-1 homolog (1024-1033)
caggagaaccccaaguuccugagccacuuu

SEQ ID NO: 70386 - RNA, 30 nt, Artificial Sequence
  RNA-binding motif, single-stranded-interacting protein 3 (126-135)
caggagcaagaccccaccaaccuguacauc

SEQ ID NO: 70387 - RNA, 33 nt, Artificial Sequence
  T-complex protein 1 subunit theta (20-30)
caggagcaagaagugggcgacgggaccaacuuc

SEQ ID NO: 70388 - RNA, 27 nt, Artificial Sequence
  ETS translocation variant 1 (65-73)
caggagcaacccuucaaguuuagcuac

SEQ ID NO: 70389 - RNA, 27 nt, Artificial Sequence
  Nucleolar complex protein 2 homolog (188-196)
caggagagcgccgaagcuaacaaguuc

SEQ ID NO: 70390 - RNA, 30 nt, Artificial Sequence
  Protein transport protein Sec24D (86-95)
caggagagccaauccgugauccacaaccug

SEQ ID NO: 70391 - RNA, 30 nt, Artificial Sequence
  Ankycorbin (839-848)
caggaggugaacgaacugcuccaaaaguuc

SEQ ID NO: 70392 - RNA, 24 nt, Artificial Sequence
  Up-regulated during skeletal muscle growth protein 5 (11-18)
caguucaccggcaucaagaaauac

SEQ ID NO: 70393 - RNA, 30 nt, Artificial Sequence
  Proprotein convertase subtilisin/kexin type 7 (93-102)
cagggccacuaccuguucgugcaacccgcc

SEQ ID NO: 70394 - RNA, 18 nt, Artificial Sequence
  All-trans-retinol 13,14-reductase (57-62)
cagggcauccacuacauu

SEQ ID NO: 70395 - RNA, 33 nt, Artificial Sequence
  Serine/threonine-protein phosphatase 1 regulatory subunit 10 (572-582)
cagggccccgggggagguggcaucaacgugcaa

SEQ ID NO: 70396 - RNA, 36 nt, Artificial Sequence; identical to SEQ ID NO: 46169
  HLA class I histocompatibility antigen, A-23 alpha chain (354-365)

SEQ ID NO: 70397 - RNA, 30 nt, Artificial Sequence
  Fibronectin isoform 6 (1715-1724)
cagggcguggucaccacacuggagaacguu

SEQ ID NO: 70398 - RNA, 57 nt, Artificial Sequence
  Heterogeneous nuclear ribonucleoprotein L (52-70)
cagcacggcgggggagguggcgggggaggcggugccggggcugcaggaggcggcggg

SEQ ID NO: 70399 - RNA, 66 nt, Artificial Sequence
  Splicing factor, proline- and glutamine-rich (246-267)
cagcaccaucccccuuaccaccaacagcaucaccagggcccaccgcccgggggaccugguggcaga

SEQ ID NO: 70400 - RNA, 39 nt, Artificial Sequence
  Dynein heavy chain 8, axonemal (2665-2677)
cagcacaaggccgugcugcucaccggcgagcaagggaca

SEQ ID NO: 70401 - RNA, 33 nt, Artificial Sequence
  Synaptic vesicle membrane protein VAT-1 homolog (26-36)
cagcaccccgccgcuagcgagggcgcagccgcg

SEQ ID NO: 70402 - RNA, 39 nt, Artificial Sequence
  Band 4.1-like protein 2 (54-66)
cagaucgacggcggggccggaggugauagcggcacccug

SEQ ID NO: 70403 - RNA, 24 nt, Artificial Sequence
  60S ribosomal protein L26 (66-73)
cagaucggcaaggugguccaaguu

SEQ ID NO: 70404 - RNA, 27 nt, Artificial Sequence
  Cytoskeleton-associated protein 5 (1667-1675)
cagauccuggaccaccucaccaugauu

SEQ ID NO: 70405 - RNA, 27 nt, Artificial Sequence
  DNA-dependent protein kinase catalytic subunit (865-873)
cagaucaacaagaaucugcucaccgug

SEQ ID NO: 70406 - RNA, 51 nt, Artificial Sequence
  Transmembraneoprotein NMB (370-386)
cagaucaacagauacggccacuuccaagccaccauuacaauaguggagggg

SEQ ID NO: 70407 - RNA, 27 nt, Artificial Sequence
  Dehydrogenase/reductase SDR family member 2, mitochondrial (127-135)
cagaucugggacaagauucugagcgug

SEQ ID NO: 70408 - RNA, 36 nt, Artificial Sequence
  Nodal modulator 2 (399-410)
cagcuggccgacaucguggcuaccggcuucagcguc

SEQ ID NO: 70409 - RNA, 27 nt, Artificial Sequence
  Laminin subunit alpha-4 (470-478)
cagcuggacgauuacaacgccaagcuc

SEQ ID NO: 70410 - RNA, 27 nt, Artificial Sequence
  Myotubularin-related protein 6 (229-237)
cagcuggacggcgaucccaaggaggug

SEQ ID NO: 70411 - RNA, 27 nt, Artificial Sequence
  Circadian clock protein PASD1 (383-391)
cagcuggaggaaagaaccuggcuccuu

SEQ ID NO: 70412 - RNA, 21 nt, Artificial Sequence
  ATP-dependent RNA helicase DHX8 (283-289)
cagcuggagggccucagaaag

SEQ ID NO: 70413 - RNA, 27 nt, Artificial Sequence
  Erlin-2 (26-34)
cagcugggcgccguggucgcuguugca

SEQ ID NO: 70414 - RNA, 27 nt, Artificial Sequence
  Probable histidine-tRNA ligase, mitochondrial (60-68)
cagcugggcgacuuccucaucaaggug

SEQ ID NO: 70415 - RNA, 27 nt, Artificial Sequence
  Complement factor I (347-355)
cagcugggcgaccuccccuggcaagug

SEQ ID NO: 70416 - RNA, 27 nt, Artificial Sequence
  E3 ubiquitin-protein ligase TRIM63 (281-289)
cagcugaucaagagcauuguggaggcc

SEQ ID NO: 70417 - RNA, 27 nt, Artificial Sequence
  Class E basic helix-loop-helix protein 41 (161-169)
cagcugaucaaccaccuccaugccgug

SEQ ID NO: 70418 - RNA, 27 nt, Artificial Sequence
  E3 ubiquitin-protein ligase listerin (245-253)
cagcugauccccuucauugacgccgug

SEQ ID NO: 70419 - RNA, 27 nt, Artificial Sequence
  Intron-binding protein aquarius (224-232)
cagcugauccaaaaguucauuagcgug

SEQ ID NO: 70420 - RNA, 33 nt, Artificial Sequence
  Pleckstrin homology domain-containing family H member 1 (700-710)
cagcugaucagcgagaagaaaaccuacuaucuc

SEQ ID NO: 70421 - RNA, 30 nt, Artificial Sequence
  WASH complex subunit 7 (254-263)
cagcugcucgacggcaugaucuuccaagcc

SEQ ID NO: 70422 - RNA, 33 nt, Artificial Sequence
  Transmembrane protein 209 (327-337)
cagcugcucgaccacauggauagcuggaccgcc

SEQ ID NO: 70423 - RNA, 27 nt, Artificial Sequence
  StAR-related lipid transfer protein 13 (922-930)
cagcugcucggcggggugagagccguc

SEQ ID NO: 70424 - RNA, 27 nt, Artificial Sequence
  Small subunit processome component 20 homolog (1596-1604)
cagcugauggagggcaaggugguccuc

SEQ ID NO: 70425 - RNA, 27 nt, Artificial Sequence
  Serine/threonine-protein kinase mTOR (66-74)
cagcugaaccaccauaucuucgagcuc

SEQ ID NO: 70426 - RNA, 33 nt, Artificial Sequence
  Liprin-alpha-2 (76-86)
cagcugaacagcgcccucccccaagacaucgag

SEQ ID NO: 70427 - RNA, 27 nt, Artificial Sequence
  Protein Shroom4 (1452-1460)
cagcugcaagacuaccagcacuucgug

SEQ ID NO: 70428 - RNA, 39 nt, Artificial Sequence
  Plectin (3123-3135)
cagcugagcaccggcgggaucguggaccccuccaagucu

SEQ ID NO: 70429 - RNA, 27 nt, Artificial Sequence
  Protein wntless homolog (517-525)
cagcugaccacaacuaucacgcacgug

SEQ ID NO: 70430 - RNA, 27 nt, Artificial Sequence
  Chondroitin sulfate proteoglycan 4 (77-85)
cagcuguacagcggcagacuccaagug

SEQ ID NO: 70431 - RNA, 30 nt, Artificial Sequence; identical to SEQ ID NO: 46204
  Solute carrier family 12 member 6 (45-54)

SEQ ID NO: 70432 - RNA, 27 nt, Artificial Sequence
  Synemin (724-732)
cagaugaucggcgacauuauaaaccug

SEQ ID NO: 70433 - RNA, 36 nt, Artificial Sequence
  DNA-dependent protein kinase catalytic subunit (947-958)
cagaugcccgagggcgggcaaggagccccuccaaug

SEQ ID NO: 70434 - RNA, 27 nt, Artificial Sequence
  Actin-like protein 6A (239-247)
cagaugcccaccgugcacuacgaguuc

SEQ ID NO: 70435 - RNA, 27 nt, Artificial Sequence
  Talin-1 (288-296)
cagaugagcgagaucgaagccaaggug

SEQ ID NO: 70436 - RNA, 36 nt, Artificial Sequence
  L-lactate dehydrogenase A chain (20-31)
cagaacaagaucaccguggucggcguuggggccgug

SEQ ID NO: 70437 - RNA, 27 nt, Artificial Sequence
  POU domain, class 2, transcription factor 1 (208-216)
cagcccgccaccccuacaagaacuauc

SEQ ID NO: 70438 - RNA, 27 nt, Artificial Sequence
  Integrin alpha-6 (55-63)
cagcccgaggacaagagacugcuccuu

SEQ ID NO: 70439 - RNA, 33 nt, Artificial Sequence
  Beta-2-microglobulin (88-98)
cagcccaagaucgugaaaugggacagagauaug

SEQ ID NO: 70440 - RNA, 24 nt, Artificial Sequence
  Potassium voltage-gated channel subfamily H member 2 (335-342)
cagccccuggccguggucgaccuc

SEQ ID NO: 70441 - RNA, 33 nt, Artificial Sequence
  Histone-lysine N-methyltransferase 2A (3086-3096)
cagccccuguacgugcuccaaacccuuccuaac

SEQ ID NO: 70442 - RNA, 27 nt, Artificial Sequence
  Rho GTPase-activating protein 31 (988-996)
cagccccaagccccuagaagggagauc

SEQ ID NO: 70443 - RNA, 27 nt, Artificial Sequence
  Tribbles homolog 1 (15-23)
cagcccagaggcccugcccugcucuuc

SEQ ID NO: 70444 - RNA, 30 nt, Artificial Sequence
  Transcription intermediary factor 1-alpha (611-620)
cagcccagaccuccaagcaacaggaccgug

SEQ ID NO: 70445 - RNA, 27 nt, Artificial Sequence
  DNA-directed RNA polymerase II subunit RPB3 (6-14)
cagcccaccgugagaaucacagagcug

SEQ ID NO: 70446 - RNA, 36 nt, Artificial Sequence
  Guanine nucleotide exchange factor VAV3 (393-404)
cagcccgugcugcucuucggcagaccucaaggggac

SEQ ID NO: 70447 - RNA, 24 nt, Artificial Sequence
  Dual specificity protein kinase CLK3 (230-237)
cagcccuacccucugccacacgug

SEQ ID NO: 70448 - RNA, 60 nt, Artificial Sequence
  CCR4-NOT transcription complex subunit 1 (48-67)
cagcaaggcauccugaagaccgacgaucucauuacaagauucuuuaggcuuugcacugag

SEQ ID NO: 70449 - RNA, 27 nt, Artificial Sequence
  Tetratricopeptide repeat protein 37 (642-650)
cagcaaauccugggcaaguacaaagag

SEQ ID NO: 70450 - RNA, 24 nt, Artificial Sequence
  Eukaryotic initiation factor 4A-I (114-121)
cagcaaauccagaagguggucaug

SEQ ID NO: 70451 - RNA, 27 nt, Artificial Sequence
  Pyridoxal kinase (30-38)
cagcaaaaccccagacugguguacguc

SEQ ID NO: 70452 - RNA, 24 nt, Artificial Sequence
  Titin (12085-12092)
cagagagccgaggugguccccguu

SEQ ID NO: 70453 - RNA, 27 nt, Artificial Sequence
  Caprin-1 (666-674)
cagagagacggcuaccaacagaacuuc

SEQ ID NO: 70454 - RNA, 21 nt, Artificial Sequence
  Signal transducer and activator of transcription 6 (89-95)
cagagagacccccugaagcuc

SEQ ID NO: 70455 - RNA, 27 nt, Artificial Sequence
  Interleukin-24 (5-13)
cagagacugcaaagccucuggacccuu

SEQ ID NO: 70456 - RNA, 27 nt, Artificial Sequence
  Tight junction protein ZO-1 (750-758)
cagagaagcuccggcaucauuaggcug

SEQ ID NO: 70457 - RNA, 27 nt, Artificial Sequence
  Mastermind-like protein 2 (349-357)
cagagaagcacccccaggccuucccug

SEQ ID NO: 70458 - RNA, 27 nt, Artificial Sequence
  Polypyrimidine tract-binding protein 1 (384-392)
cagagagugaagauccuguucaacaaa

SEQ ID NO: 70459 - RNA, 27 nt, Artificial Sequence
  KN motif and ankyrin repeat domain-containing protein 2 (79-87)
cagagcgagaucgccuccaugcuguac

SEQ ID NO: 70460 - RNA, 30 nt, Artificial Sequence
  Nuclear factor erythroid 2-related factor 2 (93-102)
cagagcgagaccuccggcucugccaacuac

SEQ ID NO: 70461 - RNA, 21 nt, Artificial Sequence
  Golgin subfamily A member 4 (541-547)
cagagcgaguaccugaagauc

SEQ ID NO: 70462 - RNA, 30 nt, Artificial Sequence
  RNA-binding protein 27 (597-606)
cagagcggcggggccggagaggacugccaa

SEQ ID NO: 70463 - RNA, 33 nt, Artificial Sequence
  Heterogeneous nuclear ribonucleoprotein K (153-163)
cagagccuggccggcgggaucauuggagugaag

SEQ ID NO: 70464 - RNA, 30 nt, Artificial Sequence
  Interphotoreceptor matrix proteoglycan 1 (289-298)
cagagccuggacgugggcaccauccaauuc

SEQ ID NO: 70465 - RNA, 27 nt, Artificial Sequence
  Hsc70-interacting protein (339-347)
cagagcaaccccaaggugaugaaucug

SEQ ID NO: 70466 - RNA, 27 nt, Artificial Sequence
  Hemicentin-1 (1877-1885)
cagagcuccggcagagugcugcaaauc

SEQ ID NO: 70467 - RNA, 27 nt, Artificial Sequence
  CUB and sushi domain-containing protein 3 (16-24)
cagaccgccagcggcuucaucuacaca

SEQ ID NO: 70468 - RNA, 27 nt, Artificial Sequence
  Nodal modulator 1 (450-458)
cagaccuucccccugacagugacuaac

SEQ ID NO: 70469 - RNA, 36 nt, Artificial Sequence
  Receptor-type tyrosine-protein phosphatase delta (33-44)
cagaccggcgugagcgggggagucgccuccuucauc

SEQ ID NO: 70470 - RNA, 27 nt, Artificial Sequence
  Ribosome maturation protein SBDS (52-60)
cagacccacagcguguucgucaacguu

SEQ ID NO: 70471 - RNA, 30 nt, Artificial Sequence
  Histone-lysine N-methyltransferase EHMT1 (170-179)
cagacccccgccgcuccuccagcaacacug

SEQ ID NO: 70472 - RNA, 21 nt, Artificial Sequence
  rRNA 2'-O-methyltransferase fibrillarin (239-245)
cagaccagaaucguggcccug

SEQ ID NO: 70473 - RNA, 33 nt, Artificial Sequence
  Protein FAM135A (647-657)
cagaccacacccagccugggcgugagaacuauc

SEQ ID NO: 70474 - RNA, 30 nt, Artificial Sequence
  Catenin beta-1 (78-87)
cagguggccgacaucgauggccaauacgcu

SEQ ID NO: 70475 - RNA, 123 nt, Artificial Sequence
  E1A-binding protein p400 (51-91)
cagguggccagccugagagcugagaggaucgcaaaggaaaaaaaggcccucgcggaccaacagaaagcucagcagcccgccgucgcacaaccuccaccgccccagccucagccacccccucca

SEQ ID NO: 70476 - RNA, 30 nt, Artificial Sequence
  Integrator complex subunit 1 (125-134)
cagguggccagcagaguccuggcuaugaag

SEQ ID NO: 70477 - RNA, 27 nt, Artificial Sequence
  ATP-binding cassette sub-family A member 2 (2330-2338)
cagguguucagcaagauggagcaaguc

SEQ ID NO: 70478 - RNA, 42 nt, Artificial Sequence
  Zinc finger protein 423 (1103-1116)
caggugggcgggcuggcccccccugagccagcugacagaccg

SEQ ID NO: 70479 - RNA, 30 nt, Artificial Sequence
  Transcription factor SOX-5 (88-97)
caggugcuggacggcaaggucgccguugug

SEQ ID NO: 70480 - RNA, 45 nt, Artificial Sequence
  T-complex protein 1 subunit beta (502-516)
caggugcugcucagcgccgcugaggcagccgaagucauccuuaga

SEQ ID NO: 70481 - RNA, 21 nt, Artificial Sequence
  Peptidyl-prolyl cis-trans isomerase FKBP9 (200-206)
caggugcaaauccacaccuac

SEQ ID NO: 70482 - RNA, 63 nt, Artificial Sequence
  Poly(rC)-binding protein 2 (304-324)
caggugaccaucacaggcagcgccgcuuccauuucucuggcacaauaccucauaaacgucaga

SEQ ID NO: 70483 - RNA, 27 nt, Artificial Sequence
  Transcriptional regulator ATRX (1486-1494)
cagguggucagcuuccugcacaccguu

SEQ ID NO: 70484 - RNA, 27 nt, Artificial Sequence
  14-3-3 protein eta (46-54)
caguacgagagcaagguguucuaucug

SEQ ID NO: 70485 - RNA, 27 nt, Artificial Sequence
  TELO2-interacting protein 1 homolog (50-58)
caguacauccuguucccccucagauuu

SEQ ID NO: 70486 - RNA, 27 nt, Artificial Sequence
  Vam6/Vps39-like protein (296-304)
caguaccccaacccucugccagugcuc

SEQ ID NO: 70487 - RNA, 45 nt, Artificial Sequence
  Forkhead box protein D3 (302-316)
caguaccccuaugcccugccuccaguggcuccgguccuccccccu

SEQ ID NO: 70488 - RNA, 27 nt, Artificial Sequence
  Spectrin beta chain, non-erythrocytic 1 (17-25)
caguacagcgacgugaacaauagaugg

SEQ ID NO: 70489 - RNA, 30 nt, Artificial Sequence
  Ubiquitin-like modifier-activating enzyme 1 (717-726)
caguacagcaacaauaucagacaacugcuc

SEQ ID NO: 70490 - RNA, 30 nt, Artificial Sequence
  Golgin subfamily A member 4 (432-441)
agagccgcuuucgaggaacuggagaaggca

SEQ ID NO: 70491 - RNA, 27 nt, Artificial Sequence
  HDAC2 (27-35)
agagccuuccccgcuccuccaccgcug

SEQ ID NO: 70492 - RNA, 27 nt, Artificial Sequence
  Formin-like protein 2 (15-23)
agagcccacaacgugccccugaagcuc

SEQ ID NO: 70493 - RNA, 27 nt, Artificial Sequence
  Catenin beta-1 (151-159)
agagccauccccgagcugaccaagcuc

SEQ ID NO: 70494 - RNA, 33 nt, Artificial Sequence
  Fatty acid synthase (2352-2362)
agagccaagcugacccccggcugcgaggcugaa

SEQ ID NO: 70495 - RNA, 27 nt, Artificial Sequence
  Junction plakoglobin (142-150)
agagcccugcccgagcucaccaagcuu

SEQ ID NO: 70496 - RNA, 24 nt, Artificial Sequence
  Astrotactin-2 (360-367)
agagccaacacccccaucgagauu

SEQ ID NO: 70497 - RNA, 27 nt, Artificial Sequence
  Microtubule-associated protein 4 (356-364)
agagccagccccaucaagauggaccug

SEQ ID NO: 70498 - RNA, 27 nt, Artificial Sequence
  Protein scribble homolog (473-481)
agagccaccccccacccuagcgagcug

SEQ ID NO: 70499 - RNA, 33 nt, Artificial Sequence
  Perilipin-2 (230-240)
agagccuaccagcaagcucugagcagggugaag

SEQ ID NO: 70500 - RNA, 27 nt, Artificial Sequence
  Probable E3 ubiquitin-protein ligase HERC1 (2112-2120)
agagccuacagcggcaaccuguaucac

SEQ ID NO: 70501 - RNA, 27 nt, Artificial Sequence
  Fibronectin isoform 6 (1162-1170)
agagacgcccccaucgugaacaagguc

SEQ ID NO: 70502 - RNA, 51 nt, Artificial Sequence
  Vimentin (450-466)
agagacggccaggugaucaacgagaccagccaacaccaugaugaccuggaa

SEQ ID NO: 70503 - RNA, 45 nt, Artificial Sequence
  Protein NipSnap homolog 2 (40-54)
agagaggacagcuggcugaagucccucuucgugaggaaagucgau

SEQ ID NO: 70504 - RNA, 33 nt, Artificial Sequence
  Vimentin (196-206)
agagaggaagccgagaacacccugcagagcuuc

SEQ ID NO: 70505 - RNA, 27 nt, Artificial Sequence
  Transcription elongation factor SPT5 (606-614)
agagagggcgaaaucaggcaccuguuc

SEQ ID NO: 70506 - RNA, 129 nt, Artificial Sequence
  Vimentin (258-300)
agagagaccaaccuggacagccucccccuuguggauacacacuccaagaggacucuguugaucaaaacggucgaaacccgggacggccagguuauuaaugagacaucucaacaucacgaugacuuagaa

SEQ ID NO: 70507 - RNA, 24 nt, Artificial Sequence
  Myosin-7 (243-250)
agauucggcaaguuuaucaggauu

SEQ ID NO: 70508 - RNA, 36 nt, Artificial Sequence
  Protein YIF1B (85-96)
agauucauccccauuaccaagcugaaauacuauuuu

SEQ ID NO: 70509 - RNA, 33 nt, Artificial Sequence
  Filamin-A (2059-2069)
agauucauccccagggagaacggcguguaccug

SEQ ID NO: 70510 - RNA, 27 nt, Artificial Sequence
  Uncharacterized protein C11orf96 (157-165)
agauucaagacccagcccgugacauuu

SEQ ID NO: 70511 - RNA, 27 nt, Artificial Sequence
  Serine/threonine-protein phosphatase 2A 56 kDa regulatory subunit epsilon isoform (227-235)
agauucguguacgagaccgaacacuuu

SEQ ID NO: 70512 - RNA, 39 nt, Artificial Sequence
  NADH dehydrogenase (ubiquinone) 1 beta subcomplex subunit 5, mitochondrial (61-73)
agauucuacgacaggcgguuucugaagcuccuucgcuuc

SEQ ID NO: 70513 - RNA, 33 nt, Artificial Sequence
  Collagen alpha-2(I) chain (495-505)
agaggcgcccccggggcugugggagcaccuggu

SEQ ID NO: 70514 - RNA, 30 nt, Artificial Sequence
  Nuclear receptor corepressor 2 (1514-1523)
agaggcgcccccgugaucgucccugagcug

SEQ ID NO: 70515 - RNA, 27 nt, Artificial Sequence
  Pre-mRNA-processing-splicing factor 8 (763-771)
agaggcgccaccguggacaagacaguc

SEQ ID NO: 70516 - RNA, 30 nt, Artificial Sequence
  Inositol 1,4,5-trisphosphate receptor type 2 (1365-1374)
agaggcgacgagagcgggccccuggccuac

SEQ ID NO: 70517 - RNA, 27 nt, Artificial Sequence
  Collagen alpha-2(V) chain (785-793)
agaggcuucaccgggcugcagggacuc

SEQ ID NO: 70518 - RNA, 30 nt, Artificial Sequence
  Inactive phospholipase C-like protein 2 (6-15)
agaggcggggccgcuggaggugcacugccc

SEQ ID NO: 70519 - RNA, 24 nt, Artificial Sequence
  Eukaryotic translation initiation factor 4 gamma 1 (993-1000)
agaggcgggcccccuggaccaccg

SEQ ID NO: 70520 - RNA, 33 nt, Artificial Sequence
  Plexin-B3 (190-200)
agaggccuggccgggaagcucagcgcuggagug

SEQ ID NO: 70521 - RNA, 42 nt, Artificial Sequence
  Collagen alpha-1(III) chain (761-774)
agaggccccaccgggccuaucggaccaccgggucccgccggc

SEQ ID NO: 70522 - RNA, 27 nt, Artificial Sequence
  Heat shock protein HSP 90-beta (103-111)
agaggcaccaaggugauccugcaccuc

SEQ ID NO: 70523 - RNA, 27 nt, Artificial Sequence
  UDP-N-acetylhexosamine pyrophosphorylase-like protein 1 (111-119)
agaggcguggaguucguccacguuuac

SEQ ID NO: 70524 - RNA, 18 nt, Artificial Sequence
  Msx2-interacting protein (535-540)
agacacuucugcagguac

SEQ ID NO: 70525 - RNA, 30 nt, Artificial Sequence
  Krueppel-like factor 15 (280-289)
agaaucgcccccgugccuauugcugcaaag

SEQ ID NO: 70526 - RNA, 30 nt, Artificial Sequence
  Phosphoglycerate kinase 1 (39-48)
agaaucaaggccgcugugcccagcauuaaa

SEQ ID NO: 70527 - RNA, 24 nt, Artificial Sequence
  General transcription factor II-I (492-499)
agaaucaaguucgugauuaaaagg

SEQ ID NO: 70528 - RNA, 33 nt, Artificial Sequence
  Alpha-globin transcription factor CP2 (148-158)
agaauccuggacauugauauacccaugagcgug

SEQ ID NO: 70529 - RNA, 27 nt, Artificial Sequence
  Asparagine synthetase (glutamine-hydrolyzing) (153-161)
agaauccuguucaacaaugccgugaag

SEQ ID NO: 70530 - RNA, 27 nt, Artificial Sequence
  Nuclear factor of activated T-cells, cytoplasmic 2 (247-255)
agaauccugaagccccacgccuucuac

SEQ ID NO: 70531 - RNA, 30 nt, Artificial Sequence
  cAMP-dependent protein kinase type I-beta regulatory subunit (233-242)
agaauccugaugggcagcacccucaggaag

SEQ ID NO: 70532 - RNA, 33 nt, Artificial Sequence
  CCR4-NOT transcription complex subunit 1 (238-248)
agaauccugcccgacagcggcgggguggccaag

SEQ ID NO: 70533 - RNA, 27 nt, Artificial Sequence
  Centrin-2 (164-172)
agaaucaugaagaaaaccagccuguac

SEQ ID NO: 70534 - RNA, 30 nt, Artificial Sequence
  Transcription factor HES-1 (49-58)
agaaucaacgagagccugucccagcucaag

SEQ ID NO: 70535 - RNA, 27 nt, Artificial Sequence
  Vigilin (291-299)
agaaucaacauucccccuccaagcgug

SEQ ID NO: 70536 - RNA, 27 nt, Artificial Sequence
  Pumilio homolog 1 (920-928)
agaaucaggggccacgugcugagccuc

SEQ ID NO: 70537 - RNA, 27 nt, Artificial Sequence
  Proteasome subunit beta type-5 (76-84)
agaaucagcggcgccaccuucuccgug

SEQ ID NO: 70538 - RNA, 33 nt, Artificial Sequence
  Cubilin (1911-1921)
agaaucuacgacggccccagcauucacgccagg

SEQ ID NO: 70539 - RNA, 27 nt, Artificial Sequence
  Centrosomal protein C10orf90 (654-662)
agaaucuacgacaaccugcccgaggug

SEQ ID NO: 70540 - RNA, 39 nt, Artificial Sequence
  Probable phospholipid-transporting ATPase VB (153-165)
agaaucuacgagaggaaggaacagaccuaugugcaaaaa

SEQ ID NO: 70541 - RNA, 81 nt, Artificial Sequence
  HLA class I histocompatibility antigen, A-23 alpha chain (339-365)
agaaagggcgggagcuacucccaggccgcuucuucagacagugcacaaggaagcgaugugucccugaccgccugcaaaguc

SEQ ID NO: 70542 - RNA, 81 nt, Artificial Sequence
  HLA class I histocompatibility antigen, A-1 alpha chain (314-340)
agaaagggcgggagcuacacccaggccgcuuccucugacucagcacaaggaagugaugugagccugacagccugcaaaguc

SEQ ID NO: 70543 - RNA, 27 nt, Artificial Sequence
  Ellis-van Creveld syndrome protein (396-404)
agacuggccgcuaucagccacggccuc

SEQ ID NO: 70544 - RNA, 27 nt, Artificial Sequence
  Interferon-induced protein with tetratricopeptide repeats 1 (110-118)
agacuggccgaggcucagaccuaccuc

SEQ ID NO: 70545 - RNA, 27 nt, Artificial Sequence
  EMILIN-1 (205-213)
agacuggccgaggacgugcagagggcu

SEQ ID NO: 70546 - RNA, 27 nt, Artificial Sequence
  Periodic tryptophan protein 2 homolog (276-284)
agacuggccaaguacuucuuuaacaaa

SEQ ID NO: 70547 - RNA, 27 nt, Artificial Sequence
  Keratin, type I cytoskeletal 24 (150-158)
agacuggccaacuaccucgacaaggug

SEQ ID NO: 70548 - RNA, 27 nt, Artificial Sequence
  Histone-lysine N-methyltransferase 2D (2762-2770)
agacuggcccccagcauggcuauggug

SEQ ID NO: 70549 - RNA, 27 nt, Artificial Sequence
  Ankyrin-2 (1004-1012)
agacuggccaccaugcccccuauggug

SEQ ID NO: 70550 - RNA, 30 nt, Artificial Sequence
  Coatomer subunit gamma-1 (208-217)
agacuggccgugaacaagaugaucagcaaa

SEQ ID NO: 70551 - RNA, 27 nt, Artificial Sequence
  Apolipoprotein E (246-254)
agacuggacgaggugaaggaacagguc

SEQ ID NO: 70552 - RNA, 24 nt, Artificial Sequence
  Vimentin (217-224)
agacuggaccucgagaggaaggug

SEQ ID NO: 70553 - RNA, 30 nt, Artificial Sequence
  Protein kinase C and casein kinase substrate in neurons protein 2 (468-477)
agacuggacaacggccagguggggcucuac

SEQ ID NO: 70554 - RNA, 27 nt, Artificial Sequence
  Sestrin-3 (71-79)
agacuggacaacaucacccaggugaug

SEQ ID NO: 70555 - RNA, 27 nt, Artificial Sequence
  Glutamine and serine-rich protein 1 (616-624)
agacuggaggaccaggugaucggcguc

SEQ ID NO: 70556 - RNA, 27 nt, Artificial Sequence
  Myosin-10 (1407-1415)
agacuggaggaaaaggcccucgcuuac

SEQ ID NO: 70557 - RNA, 33 nt, Artificial Sequence
  40S ribosomal protein S9 (9-19)
agacuguucgagggcaacgcccuccuuaggcgg

SEQ ID NO: 70558 - RNA, 27 nt, Artificial Sequence
  Spectrin beta chain, erythrocytic (38-46)
agacuguucgagaggagccggaucaag

SEQ ID NO: 70559 - RNA, 27 nt, Artificial Sequence
  Unconventional myosin-XVIIIa (821-829)
agacuguuccacgagaggaccuuugug

SEQ ID NO: 70560 - RNA, 30 nt, Artificial Sequence
  Cytochrome P450 4V2 (390-399)
agacuguuccccagcgugccucucuuugcc

SEQ ID NO: 70561 - RNA, 27 nt, Artificial Sequence
  Mitogen-activated protein kinase-binding protein 1 (328-336)
agacuguucagcggcguggccaacgcu

SEQ ID NO: 70562 - RNA, 27 nt, Artificial Sequence
  Cysteine andine-rich protein 2 (87-95)
agacugggcaucaagcccgagagcgug

SEQ ID NO: 70563 - RNA, 24 nt, Artificial Sequence
  E3 ubiquitin-protein ligase HECTD1 (175-182)
agacugggcgugaucagcaagguc

SEQ ID NO: 70564 - RNA, 27 nt, Artificial Sequence
  Protein fantom (56-64)
agacugcacgacgagaacauccuccuu

SEQ ID NO: 70565 - RNA, 30 nt, Artificial Sequence
  General transcription factor 3C polypeptide 1 (377-386)
agacugaucgagagccucuucaccauucag

SEQ ID NO: 70566 - RNA, 27 nt, Artificial Sequence
  Heterogeneous nuclear ribonucleoprotein U-like protein 1 (490-498)
agacugauccagauugccgcuaggaag

SEQ ID NO: 70567 - RNA, 27 nt, Artificial Sequence
  Cytochrome c oxidase subunit 2 (134-142)
agacugcucgacguggauaacaggguc

SEQ ID NO: 70568 - RNA, 33 nt, Artificial Sequence
  Keratin, type I cytoskeletal 18 (324-334)
agacugcucgaggacggcgaagauuucaaccuu

SEQ ID NO: 70569 - RNA, 30 nt, Artificial Sequence
  Cytoplasmic FMR1-interacting protein 1 (113-122)
agacugcucggcuaccaggggaucgccgug

SEQ ID NO: 70570 - RNA, 30 nt, Artificial Sequence
  Histone-lysine N-methyltransferase 2D (4468-4477)
agacugcucaaccuugaccuggauuugugg

SEQ ID NO: 70571 - RNA, 33 nt, Artificial Sequence
  Homeobox protein Hox-B9 (220-230)
agacugcucaaccuuagcgagaggcaggugaag

SEQ ID NO: 70572 - RNA, 27 nt, Artificial Sequence
  Apolipoprotein C-II (4-12)
agacugcuccccgcccuuuuccuggug

SEQ ID NO: 70573 - RNA, 30 nt, Artificial Sequence
  Syndecan-3 (138-147)
agacugcucccccuuccucugaccacagug

SEQ ID NO: 70574 - RNA, 39 nt, Artificial Sequence
  Long-chain fatty acid transport protein 1 (273-285)
agacugcucccccagguggacaccacaggcacuuucaag

SEQ ID NO: 70575 - RNA, 27 nt, Artificial Sequence
  Muskelin (14-22)
agacugcuccccuacgcccuucacaag

SEQ ID NO: 70576 - RNA, 27 nt, Artificial Sequence
  Regulator of G-protein signaling 12 (718-726)
agacugcuccaggaccccgugggcguc

SEQ ID NO: 70577 - RNA, 33 nt, Artificial Sequence
  G2/mitotic-specific cyclin-B1 (217-227)
agacugcuccaggagaccauguacaugacagug

SEQ ID NO: 70578 - RNA, 33 nt, Artificial Sequence
  Interleukin-24 (90-100)
agacugcuccagcaagaggugcuucagaacguc

SEQ ID NO: 70579 - RNA, 27 nt, Artificial Sequence
  Unconventional myosin-Ic (138-146)
agacugcuccagagcaaccccgugcuu

SEQ ID NO: 70580 - RNA, 30 nt, Artificial Sequence
  AP-1 complex subunit beta-1 (528-537)
agacugcucagcaccgaccccguggccgcu

SEQ ID NO: 70581 - RNA, 27 nt, Artificial Sequence
  Neurochondrin (561-569)
agacugcucagcaccucccccgcccuu

SEQ ID NO: 70582 - RNA, 30 nt, Artificial Sequence
  Bombesin receptor-activated protein C6orf89 (119-128)
agacugaugagccuccccaucgccaagaaa

SEQ ID NO: 70583 - RNA, 27 nt, Artificial Sequence
  Cytochrome c oxidase subunit 2 (178-186)
agacugaaccagaccacauucacugcc

SEQ ID NO: 70584 - RNA, 27 nt, Artificial Sequence
  Lysosome-associated membraneoprotein 2 (273-281)
agacugaacagcuccaccaucaaguac

SEQ ID NO: 70585 - RNA, 27 nt, Artificial Sequence
  Lysosomal thioesterase PPT2 (8-16)
agacugcccgccgcuugggugcuccuu

SEQ ID NO: 70586 - RNA, 30 nt, Artificial Sequence
  Protein scribble homolog (257-266)
agacugcccgacggcaucgggcagcucaag

SEQ ID NO: 70587 - RNA, 27 nt, Artificial Sequence
  Neuron navigator 2 (921-929)
agacugcccgacggcauggccgugguc

SEQ ID NO: 70588 - RNA, 30 nt, Artificial Sequence
  Lysine-specific demethylase 5B (1280-1289)
agacugcccgagggcgacgcccucagguac

SEQ ID NO: 70589 - RNA, 33 nt, Artificial Sequence
  Transformation/transcription domain-associated protein (696-706)
agacugcccgagaugggcagcaacguggaacuc

SEQ ID NO: 70590 - RNA, 27 nt, Artificial Sequence
  Probable E3 ubiquitin-protein ligase HERC6 (578-586)
agacugcccgagaacaccuucaauauc

SEQ ID NO: 70591 - RNA, 27 nt, Artificial Sequence
  WD repeat-containing protein 90 (1359-1367)
agacugcccgagccugugcacggcguc

SEQ ID NO: 70592 - RNA, 33 nt, Artificial Sequence
  YrdC domain-containing protein, mitochondrial (48-58)
agacugcccggcagcggggccgugcaggcugca

SEQ ID NO: 70593 - RNA, 33 nt, Artificial Sequence
  Insulin receptor substrate 2 (1043-1053)
agacugcccccugccagcgcuguggcaaccgcc

SEQ ID NO: 70594 - RNA, 27 nt, Artificial Sequence
  Zinc finger BED domain-containing protein 6 (445-453)
agacugcccagcgagaccuacuucuuu

SEQ ID NO: 70595 - RNA, 27 nt, Artificial Sequence
  DNA-dependent protein kinase catalytic subunit (2530-2538)
agacugcccagcaacacccucgacagg

SEQ ID NO: 70596 - RNA, 27 nt, Artificial Sequence
  T-cell immunomodulatory protein (6-14)
agacugcccagcuccugggcccucuuc

SEQ ID NO: 70597 - RNA, 30 nt, Artificial Sequence
  Peroxisome proliferator-activated receptor gamma coactivator-related protein 1 (1096-1105)
agacugcaggcccccgagcucgcuaacgug

SEQ ID NO: 70598 - RNA, 27 nt, Artificial Sequence
  DNA-dependent protein kinase catalytic subunit (14-22)
agacugcaggagacccucagcgccgcu

SEQ ID NO: 70599 - RNA, 27 nt, Artificial Sequence
  DNA ligase 3 (740-748)
agacugcagaacgagcucgacauggug

SEQ ID NO: 70600 - RNA, 33 nt, Artificial Sequence
  2'-5'-oligoadenylate synthase 3 (18-28)
agacugcagcccaggaaggaguucguggaaaaa

SEQ ID NO: 70601 - RNA, 27 nt, Artificial Sequence
  Plectin (2433-2441)
agacugagggaggccaucgcugaacuc

SEQ ID NO: 70602 - RNA, 27 nt, Artificial Sequence
  Tripeptidyl-peptidase 1 (60-68)
agacugagcgagcucgugcaggccguc

SEQ ID NO: 70603 - RNA, 27 nt, Artificial Sequence
  Desumoylating isopeptidase 1 (23-31)
agacugagccccaucaugcucggcaag

SEQ ID NO: 70604 - RNA, 27 nt, Artificial Sequence
  GCN1 general control of amino-acid synthesis 1-like 1 (2013-2021)
agacugaccagcgccgacgcucucagg

SEQ ID NO: 70605 - RNA, 36 nt, Artificial Sequence
  Melanoma antigen preferentially expressed in tumors (25-36)
agacugguggagcucgccggccagagccuucugaag

SEQ ID NO: 70606 - RNA, 24 nt, Artificial Sequence
  Lysophosphatidic acid phosphatase type 6 (9-16)
agacuguggacccccgugggcguc

SEQ ID NO: 70607 - RNA, 33 nt, Artificial Sequence
  Tubulin-specific chaperone C (217-227)
agacuguacggcaaccccaauacccucaggcuu

SEQ ID NO: 70608 - RNA, 30 nt, Artificial Sequence
  Tetratricopeptide repeat protein 30A (82-91)
agacuguaccaggcccaagcucucuauaag

SEQ ID NO: 70609 - RNA, 27 nt, Artificial Sequence
  Protein asteroid homolog 1 (274-282)
agacuguacagcggcucccucgugcac

SEQ ID NO: 70610 - RNA, 27 nt, Artificial Sequence
  Filamin-A (2280-2288)
agacuguacagcguguccuaucuccuu

SEQ ID NO: 70611 - RNA, 30 nt, Artificial Sequence
  Unconventional myosin-X (1476-1485)
agacuguacaccaagcuccuuaacgaggcc

SEQ ID NO: 70612 - RNA, 30 nt, Artificial Sequence
  Vimentin (13-22)
agaauguucggcgggcccggaaccgccagc

SEQ ID NO: 70613 - RNA, 45 nt, Artificial Sequence
  Vimentin (13-27)
agaauguucggcgggcccggaaccgccagcaggccuuccucuuca

SEQ ID NO: 70614 - RNA, 48 nt, Artificial Sequence
  Vimentin (13-28)
agaauguucggcgggcccggaaccgccagcaggccuuccucuucacgg

SEQ ID NO: 70615 - RNA, 51 nt, Artificial Sequence
  Vimentin (13-29)
agaauguucggcgggcccggaaccgccagcaggccuuccucuucacggagu

SEQ ID NO: 70616 - RNA, 30 nt, Artificial Sequence
  Mitochondrial 2-oxoglutarate/malate carrier protein (240-249)
agaaugaucgacggcaagcccgaguacaaa

SEQ ID NO: 70617 - RNA, 42 nt, Artificial Sequence
  Spermine synthase (79-92)
agaaugaaggagcugagccaggacuccaccggcagggugaaa

SEQ ID NO: 70618 - RNA, 27 nt, Artificial Sequence
  Eukaryotic translation initiation factor 2 subunit 3 (352-360)
agaauggugggccagguccugggggcc

SEQ ID NO: 70619 - RNA, 30 nt, Artificial Sequence
  tRNA (adenine(58)-N(1))-methyltransferase non-catalytic subunit TRM6 (197-206)
agaaacgccgacggccugaucguggcuagc

SEQ ID NO: 70620 - RNA, 27 nt, Artificial Sequence
  Probable global transcription activator SNF2L1 (166-174)
agaaacauccccggcccucacauggug

SEQ ID NO: 70621 - RNA, 27 nt, Artificial Sequence
  Melanocyte protein PMEL (241-249)
agaaaccagccccugaccuucgcccuc

SEQ ID NO: 70622 - RNA, 96 nt, Artificial Sequence
  HLA class I histocompatibility antigen, A-23 alpha chain (334-365)
agaaacagcuccgacaggaagggcgggucuuacucacaggccgcuaguagcgauuccgcacaaggaucugacgugucgcugaccgccugcaaaguc

SEQ ID NO: 70623 - RNA, 27 nt, Artificial Sequence
  Heterogeneous nuclear ribonucleoprotein K (37-45)
agaaacaccgacgagaugguggaacug

SEQ ID NO: 70624 - RNA, 27 nt, Artificial Sequence
  V-type proton ATPase subunit D (136-144)
agaaacuacgccaaggcuguggagcug

SEQ ID NO: 70625 - RNA, 30 nt, Artificial Sequence
  Fibronectin isoform 6 (1712-1721)
agacccgcccagggcguggucaccacacug

SEQ ID NO: 70626 - RNA, 27 nt, Artificial Sequence
  Putative inactive carbonic anhydrase 5B-like protein (84-92)
agacccgcccagaagcacugggugcug

SEQ ID NO: 70627 - RNA, 27 nt, Artificial Sequence
  Glycosylated lysosomal membrane protein (121-129)
agacccgcccagccuccaaggcugcuc

SEQ ID NO: 70628 - RNA, 27 nt, Artificial Sequence
  Chondroitin sulfate synthase 2 (384-392)
agacccgccagcagguucgaggugcug

SEQ ID NO: 70629 - RNA, 24 nt, Artificial Sequence
  L-dopachrome tautomerase (266-273)
agacccgacgauccuacccugauc

SEQ ID NO: 70630 - RNA, 27 nt, Artificial Sequence
  Cancer/testis antigen 2 (82-90)
agacccgacagcaggcugcuccagcuu

SEQ ID NO: 70631 - RNA, 45 nt, Artificial Sequence
  Titin (9911-9925)
agacccggcccuccaguggggccgaucaaguucgagagcgucucc

SEQ ID NO: 70632 - RNA, 63 nt, Artificial Sequence
  Glia-derived nexin (58-78)
agaccccacgacaacaucgugauuagcccucauggcauagccuccguccuggggaugcuccag

SEQ ID NO: 70633 - RNA, 51 nt, Artificial Sequence
  Collagen alpha-2(I) chain (949-965)
agacccaaggacuacgagguggaugccacccugaaaagccucaacaaucag

SEQ ID NO: 70634 - RNA, 27 nt, Artificial Sequence
  6-phosphofructo-2-kinase/fructose-2,6-bisphosphatase 2 (486-494)
agaccccugaagccucucagcccacuu

SEQ ID NO: 70635 - RNA, 30 nt, Artificial Sequence
  Protein transport protein Sec23A (259-268)
agaccccugaggagcuccggcguggcccuc

SEQ ID NO: 70636 - RNA, 27 nt, Artificial Sequence
  VPS10 domain-containing receptor SorCS1 (1153-1161)
agacccaacgugccucagaccgagcug

SEQ ID NO: 70637 - RNA, 21 nt, Artificial Sequence
  40S ribosomal protein S26 (109-115)
agacccccuccaaagccgaug

SEQ ID NO: 70638 - RNA, 30 nt, Artificial Sequence
  Dystonin (1741-1750)
agaccccaggagggcgggaggaucacccug

SEQ ID NO: 70639 - RNA, 24 nt, Artificial Sequence
  Kelch-like protein 20 (247-254)
agaccccagcugccucaagugcuc

SEQ ID NO: 70640 - RNA, 24 nt, Artificial Sequence
  Renin receptor (59-66)
agacccagggccaccgugaugguc

SEQ ID NO: 70641 - RNA, 27 nt, Artificial Sequence
  UPF0524 protein C3orf70 (87-95)
agacccagggagccuaccaacacaauc

SEQ ID NO: 70642 - RNA, 27 nt, Artificial Sequence
  Thiosulfate sulfurtransferase/rhodanese-like domain-containing protein 2 (485-493)
agacccaggaucccucgggagcugcuc

SEQ ID NO: 70643 - RNA, 27 nt, Artificial Sequence
  Homocysteine-responsive endoplasmic reticulum-resident ubiquitin-like domain member 1 protein (48-56)
agacccaggccugaggaccagcggcug

SEQ ID NO: 70644 - RNA, 27 nt, Artificial Sequence
  Transmembraneoprotein NMB (331-339)
agacccagcaagccuaccccaucccug

SEQ ID NO: 70645 - RNA, 27 nt, Artificial Sequence
  Rho GTPase-activating protein 7 (565-573)
agacccagccugaacuccgugucucuc

SEQ ID NO: 70646 - RNA, 27 nt, Artificial Sequence
  Vimentin (45-53)
agacccagcaccuccaggucucuguac

SEQ ID NO: 70647 - RNA, 30 nt, Artificial Sequence
  Vimentin (45-54)
agacccagcaccuccaggucucuguacgcc

SEQ ID NO: 70648 - RNA, 24 nt, Artificial Sequence
  Kinase D-interacting substrate of 220 kDa (97-104)
agacccagcgugaagaccucccug

SEQ ID NO: 70649 - RNA, 27 nt, Artificial Sequence
  Integrin beta-5 (445-453)
agacccgugggcuucagggacagccug

SEQ ID NO: 70650 - RNA, 27 nt, Artificial Sequence
  Dual specificity protein phosphatase 6 (6-14)
agacccgugccuuucgccagcgagaug

SEQ ID NO: 70651 - RNA, 27 nt, Artificial Sequence
  L-dopachrome tautomerase (69-77)
agacccuggagcggcccuuacauccug

SEQ ID NO: 70652 - RNA, 27 nt, Artificial Sequence
  Mannosyl-oligosaccharide 1,2-alpha-mannosidase IB (132-140)
agacaggccgagaaguacuauauccug

SEQ ID NO: 70653 - RNA, 27 nt, Artificial Sequence
  V-type proton ATPase subunit H (132-140)
agacaggaccccuucaccgugcacaug

SEQ ID NO: 70654 - RNA, 27 nt, Artificial Sequence
  Dol-P-Man:Man(5)GlcNAc(2)-PP-Dol alpha-1,3-mannosyltransferase (218-226)
agacaguuccuguuucacuggaccgug

SEQ ID NO: 70655 - RNA, 39 nt, Artificial Sequence
  Cohesin subunit SA-1 (249-261)
agacaguacgaggccgaaaggaacaagaugaucggcaaa

SEQ ID NO: 70656 - RNA, 27 nt, Artificial Sequence
  X-ray repair cross-complementing protein 5 (431-439)
agacaguacauguucagcucccugaag

SEQ ID NO: 70657 - RNA, 21 nt, Artificial Sequence
  HLA class II histocompatibility antigen, DQ alpha 1 chain (55-61)
agaagguucgacccccaguuu

SEQ ID NO: 70658 - RNA, 27 nt, Artificial Sequence
  HLA class II histocompatibility antigen, DQ alpha 1 chain (55-63)
agaagguucgacccccaguuugcccug

SEQ ID NO: 70659 - RNA, 30 nt, Artificial Sequence
  HLA class II histocompatibility antigen, DQ alpha 1 chain (55-64)
agaagguucgacccccaguuugcccugacc

SEQ ID NO: 70660 - RNA, 27 nt, Artificial Sequence
  Inosine-5'-monophosphate dehydrogenase 2 (355-363)
agaagguucggcgugcccgucaucgcc

SEQ ID NO: 70661 - RNA, 27 nt, Artificial Sequence
  Basement membrane-specific heparan sulfate proteoglycan core protein (587-595)
agaagguuccuggugcacgacagcuuu

SEQ ID NO: 70662 - RNA, 30 nt, Artificial Sequence
  C-1-tetrahydrofolate synthase, cytoplasmic (487-496)
agaagguucagcgacauccagauucggcgc

SEQ ID NO: 70663 - RNA, 21 nt, Artificial Sequence
  PDZ domain-containing protein 2 (308-314)
agaagguucagcaagggcggg

SEQ ID NO: 70664 - RNA, 27 nt, Artificial Sequence
  Casein kinase I isoform alpha (106-114)
agaagguucaccaugaagacagugcug

SEQ ID NO: 70665 - RNA, 24 nt, Artificial Sequence
  Cytochrome c oxidase subunit 7C, mitochondrial (7-14)
agaagguucaccacaagcgugguc

SEQ ID NO: 70666 - RNA, 24 nt, Artificial Sequence
  Acyl-CoA desaturase (174-181)
agaaggggcuucuuuuucagccac

SEQ ID NO: 70667 - RNA, 111 nt, Artificial Sequence
  Growth arrest-specific protein 6 (314-350)
agaaggggcccccggccuuggcaggacauccugccaugcgugccguucagcgucgccaaguccguuaaaucucucuaccuugggcgcauguuuucaggaacccccgugauu

SEQ ID NO: 70668 - RNA, 27 nt, Artificial Sequence
  Homeobox protein Hox-A4 (244-252)
agaaggaucgagauugcccacacccug

SEQ ID NO: 70669 - RNA, 27 nt, Artificial Sequence
  WD repeat-containing protein 6 (233-241)
agaaggaucagcggccacguggggauu

SEQ ID NO: 70670 - RNA, 27 nt, Artificial Sequence
  Protein kinase C-binding protein 1 (354-362)
agaaggaaguucggcguguuuaacuac

SEQ ID NO: 70671 - RNA, 27 nt, Artificial Sequence
  Hemicentin-1 (827-835)
agaaggcuggacaacaugcccaucuuc

SEQ ID NO: 70672 - RNA, 30 nt, Artificial Sequence
  Hemicentin-1 (827-836)
agaaggcuggacaacaugcccaucuucagc

SEQ ID NO: 70673 - RNA, 33 nt, Artificial Sequence
  Hemicentin-1 (827-837)
agaaggcuggacaacaugcccaucuucagccgg

SEQ ID NO: 70674 - RNA, 27 nt, Artificial Sequence
  Golgi resident protein GCP60 (73-81)
agaaggcuggagcagcgguggggcuuc

SEQ ID NO: 70675 - RNA, 27 nt, Artificial Sequence
  N-alpha-acetyltransferase 10 (82-90)
agaaggcugggccucgcccagaagcuu

SEQ ID NO: 70676 - RNA, 27 nt, Artificial Sequence
  Caldesmon (347-355)
agaaggcugaaggaggaaaucgagcgg

SEQ ID NO: 70677 - RNA, 30 nt, Artificial Sequence
  Glyoxylate reductase/hydroxypyruvate reductase (170-179)
agaaggcugaagcccuucggcgugcagcgg

SEQ ID NO: 70678 - RNA, 27 nt, Artificial Sequence
  Ubiquitin-conjugating enzyme E2 variant 3 (9-17)
agaaggcugcucggcaaguacaaauuc

SEQ ID NO: 70679 - RNA, 30 nt, Artificial Sequence
  L-dopachrome tautomerase (529-538)
agaaggcugcggaagggcuacaccccccuc

SEQ ID NO: 70680 - RNA, 39 nt, Artificial Sequence
  Vimentin (12-24)
agaaggauguucggcgggcccggaaccgccagccggccu

SEQ ID NO: 70681 - RNA, 48 nt, Artificial Sequence
  Vimentin (12-27)
agaaggauguucggcgggcccggaaccgccagccggccuuccucuuca

SEQ ID NO: 70682 - RNA, 54 nt, Artificial Sequence
  Vimentin (12-29)
agaaggauguucggcgggcccggaaccgccagccggccuuccucuucacgcagu

SEQ ID NO: 70683 - RNA, 27 nt, Artificial Sequence
  G-protein coupled receptor 143 (256-264)
agaaggaugggcgccgugaucaagauu

SEQ ID NO: 70684 - RNA, 27 nt, Artificial Sequence
  Polymerase I and transcript release factor (148-156)
agaaggaacuucaaggugaugaucuac

SEQ ID NO: 70685 - RNA, 99 nt, Artificial Sequence
  HLA class I histocompatibility antigen, A-23 alpha chain (333-365)
agaaggaacagcuccgaccggaagggcgggucuuacucacaggccgcuaguagcgauuccgcacaaggaucugacgugucgcugaccgccugcaaaguc

SEQ ID NO: 70686 - RNA, 30 nt, Artificial Sequence
  Sodium/potassium-transporting ATPase subunit alpha-3 (943-952)
agaaggaacagcguguuccagcaaggcaug

SEQ ID NO: 70687 - RNA, 27 nt, Artificial Sequence
  NADH dehydrogenase (ubiquinone) 1 alpha subcomplex subunit 13 (48-56)
agaaggcggcugcagaucgaggacuuc

SEQ ID NO: 70688 - RNA, 27 nt, Artificial Sequence
  Dual specificity protein phosphatase 4 (313-321)
agaaggagcaucauuucccccaacuuc

SEQ ID NO: 70689 - RNA, 27 nt, Artificial Sequence
  Hsp90 co-chaperone Cdc37 (166-174)
agaaggugggacgauagccagaaguac

SEQ ID NO: 70690 - RNA, 27 nt, Artificial Sequence
  Transmembraneoprotein NMB (169-177)
agaagguggaacuucaucuacguguuu

SEQ ID NO: 70691 - RNA, 30 nt, Artificial Sequence
  Transmembraneoprotein NMB (169-178)
agaagguggaacuucaucuacguguuucac

SEQ ID NO: 70692 - RNA, 27 nt, Artificial Sequence
  Eukaryotic translation initiation factor 3 subunit L (537-545)
agaagguacggcgacuucuuuauccgg

SEQ ID NO: 70693 - RNA, 24 nt, Artificial Sequence
  Eukaryotic initiation factor 4A-I (168-175)
agaagguaccugagccccaaguau

SEQ ID NO: 70694 - RNA, 27 nt, Artificial Sequence
  Chondroitin sulfate glucuronyltransferase (416-424)
agaagguaccagccccggcugcgcuuc

SEQ ID NO: 70695 - RNA, 36 nt, Artificial Sequence
  60S ribosomal protein L6 (59-70)
agaagcgccauguacuccaggaaggcuauguauaaa

SEQ ID NO: 70696 - RNA, 27 nt, Artificial Sequence
  Krueppel-like factor 6 (250-258)
agaagcgacgagcugaccaggcacuuc

SEQ ID NO: 70697 - RNA, 27 nt, Artificial Sequence
  Synaptotagmin-like protein 2 (665-673)
agaagcgaccccuacgugaaggccuau

SEQ ID NO: 70698 - RNA, 24 nt, Artificial Sequence
  Isoleucine-tRNA ligase, cytoplasmic (402-409)
agaagcgacaccccccugaucuac

SEQ ID NO: 70699 - RNA, 27 nt, Artificial Sequence
  ETS homologous factor (209-217)
agaagcgagggcguguucagguuucug

SEQ ID NO: 70700 - RNA, 27 nt, Artificial Sequence
  Phosphatidylinositide phosphatase SAC2 (349-357)
agaagcgagaaggaaaccguggccuac

SEQ ID NO: 70701 - RNA, 60 nt, Artificial Sequence
  Keratin, type I cytoskeletal 9 (13-32)
agaagcggcgggggagguggcgggggacugggcuccggugggucuaucaggucaaguuac

SEQ ID NO: 70702 - RNA, 30 nt, Artificial Sequence
  Son of sevenless homolog 2 (593-602)
agaagcggcauccccauuauaaagggggga

SEQ ID NO: 70703 - RNA, 27 nt, Artificial Sequence
  Manganese-transporting ATPase 13A1 (667-675)
agaagcaucgacggcuccauugugcug

SEQ ID NO: 70704 - RNA, 27 nt, Artificial Sequence
  Basement membrane-specific heparan sulfate proteoglycan core protein (92-100)
agaagcaucgaguacuccccccagcug

SEQ ID NO: 70705 - RNA, 27 nt, Artificial Sequence
  Fragile X mental retardation syndrome-related protein 1 (190-198)
agaagcaucaggaccaagcugaugcuc

SEQ ID NO: 70706 - RNA, 27 nt, Artificial Sequence
  LIM domain kinase 2 (381-389)
agaagccuggaccaccccaacgugcuc

SEQ ID NO: 70707 - RNA, 48 nt, Artificial Sequence
  rRNA-processing protein UTP23 homolog (234-249)
agaagcaaccccaaggugcuguccgagaaacagaaugccgaaggcgag

SEQ ID NO: 70708 - RNA, 39 nt, Artificial Sequence
  Histone H2B type 2-F (32-44)
agaagcaggaaggaguccuacucuguguaugucuacaaa

SEQ ID NO: 70709 - RNA, 27 nt, Artificial Sequence
  Deoxynucleotidyltransferase terminal-interacting protein 2 (272-280)
agaagcuccgagaacauccugaccgug

SEQ ID NO: 70710 - RNA, 24 nt, Artificial Sequence
  DNA replication licensing factor MCM5 (603-610)
agaagcuccauccccauuaccgug

SEQ ID NO: 70711 - RNA, 30 nt, Artificial Sequence
  DBIRD complex subunit ZNF326 (80-89)
agaagcucccugggcgggagggaccucuac

SEQ ID NO: 70712 - RNA, 27 nt, Artificial Sequence
  HMG box-containing protein 1 (133-141)
agaagcucccccgugcacaucauugcc

SEQ ID NO: 70713 - RNA, 27 nt, Artificial Sequence
  Helicase with zinc finger domain 2 (147-155)
agaagcuccucugaggugcugguccuc

SEQ ID NO: 70714 - RNA, 27 nt, Artificial Sequence
  Cytoplasmic dynein 1 heavy chain 1 (3474-3482)
agaagcaccgcccugcucaagucccuu

SEQ ID NO: 70715 - RNA, 27 nt, Artificial Sequence
  Cyclin-dependent kinase 5 activator 1 (179-187)
agaagcguggacaggucccugcuccuu

SEQ ID NO: 70716 - RNA, 27 nt, Artificial Sequence
  Annexin A2 (220-228)
agaagcgugccccaccugcagaagguc

SEQ ID NO: 70717 - RNA, 27 nt, Artificial Sequence
  Proline and serine-rich protein 2 (7-15)
agaagcgugcccaccccucuggucaug

SEQ ID NO: 70718 - RNA, 27 nt, Artificial Sequence
  Signal peptidase complex subunit 3 (35-43)
agaagcgugcccgucaggcugcacguu

SEQ ID NO: 70719 - RNA, 33 nt, Artificial Sequence
  Zinc finger protein 770 (328-338)
agaagcuacaacuauaagaccaucgugaaaaag

SEQ ID NO: 70720 - RNA, 39 nt, Artificial Sequence
  Protein Hook homolog 3 (706-718)
agaagcuaccccggccacgugcagccugccaccgcuagg

SEQ ID NO: 70721 - RNA, 27 nt, Artificial Sequence
  Annexin A1 (228-236)
agaagcuacccccagcugaggcgggug

SEQ ID NO: 70722 - RNA, 27 nt, Artificial Sequence
  Coatomer subunit alpha (1106-1114)
agaaccgcccugaaccucuucuuuaag

SEQ ID NO: 70723 - RNA, 27 nt, Artificial Sequence
  Neuron navigator 2 (898-906)
agaaccgacgauaucacaagcggcuac

SEQ ID NO: 70724 - RNA, 27 nt, Artificial Sequence
  Glycine-tRNA ligase (606-614)
agaaccgacgagaucggcguggccuuc

SEQ ID NO: 70725 - RNA, 27 nt, Artificial Sequence
  Cirhin (46-54)
agaaccgacggcacaguggagaucuac

SEQ ID NO: 70726 - RNA, 27 nt, Artificial Sequence
  Origin recognition complex subunit 5 (322-330)
agaaccgacaagagguucuuucugaaa

SEQ ID NO: 70727 - RNA, 30 nt, Artificial Sequence
  1-phosphatidylinositol 4,5-bisphosphate phosphodiesterase beta-1 (39-48)
agaaccgacccccagggcuucuuuuucuac

SEQ ID NO: 70728 - RNA, 27 nt, Artificial Sequence
  Dedicator of cytokinesis protein 9 (1494-1502)
agaaccgaggccagccagcugcucuac

SEQ ID NO: 70729 - RNA, 27 nt, Artificial Sequence
  DDB1- and CUL4-associated factor 16 (191-199)
agaaccgagcccaucaacacaacuuac

SEQ ID NO: 70730 - RNA, 27 nt, Artificial Sequence
  Rho guanine nucleotide exchange factor 2 (679-687)
agaaccuucaacggcagcaucgagcug

SEQ ID NO: 70731 - RNA, 33 nt, Artificial Sequence
  Insulin receptor substrate 2 (718-728)
agaaccuuccccgccagcggcgggggauacaag

SEQ ID NO: 70732 - RNA, 24 nt, Artificial Sequence
  Vigilin (146-153)
agaaccggcgcccaccuggagcuc

SEQ ID NO: 70733 - RNA, 24 nt, Artificial Sequence
  E3 ubiquitin-protein ligase HERC2 (17-24)
agaaccggcagcccccugucccuc

SEQ ID NO: 70734 - RNA, 39 nt, Artificial Sequence
  Prelamin-A/C (16-28)
agaaccggcacacugcucgcccagcaccccgcuuggggg

SEQ ID NO: 70735 - RNA, 27 nt, Artificial Sequence
  TGF-beta receptor type-1 (199-207)
agaaccaucgccaggacaauugugcug

SEQ ID NO: 70736 - RNA, 27 nt, Artificial Sequence
  Nuclear pore complex protein Nup155 (332-340)
agaaccaucgacaggagcguguucaag

SEQ ID NO: 70737 - RNA, 27 nt, Artificial Sequence
  Protein CASP (616-624)
agaaccaucggcuucuuuuacacacug

SEQ ID NO: 70738 - RNA, 27 nt, Artificial Sequence
  Bifunctional glutamate/proline-tRNA ligase (1278-1286)
agaaccaucggcgugaugacaaugguc

SEQ ID NO: 70739 - RNA, 27 nt, Artificial Sequence
  Helicase-like transcription factor (616-624)
agaaccauccagaggcccgugacaaug

SEQ ID NO: 70740 - RNA, 27 nt, Artificial Sequence
  AF4/FMR2 family member 4 (46-54)
agaaccaucagccaguccucuucacug

SEQ ID NO: 70741 - RNA, 27 nt, Artificial Sequence
  Ankyrin repeat domain-containing protein 17 (1031-1039)
agaaccaaggacacaccccugagccuc

SEQ ID NO: 70742 - RNA, 27 nt, Artificial Sequence
  Inositol 1,4,5-trisphosphate receptor type 3 (1667-1675)
agaacccugcagcaaaugcuccuuaag

SEQ ID NO: 70743 - RNA, 33 nt, Artificial Sequence
  Phosphatidylserine synthase 1 (8-18)
agaacccugagcaaggacgaugugaacuacaaa

SEQ ID NO: 70744 - RNA, 84 nt, Artificial Sequence
  Heat shock cognate 71 kDa protein (272-299)
agaacccugagcuccucuacacaggccucaaucgagauugacagucucuacgaaggcauagauuucuauacuagcaucacgagg

SEQ ID NO: 70745 - RNA, 27 nt, Artificial Sequence
  60S ribosomal protein L18 (55-63)
agaaccaacaggcccccucugagccuc

SEQ ID NO: 70746 - RNA, 27 nt, Artificial Sequence
  60S ribosomal protein L18 (38-46)
agaaccaacagcacauucaaucaggug

SEQ ID NO: 70747 - RNA, 27 nt, Artificial Sequence
  HLA class II histocompatibility antigen, DM beta chain (111-119)
agaaccaggcccccuagcgugcagguc

SEQ ID NO: 70748 - RNA, 27 nt, Artificial Sequence
  Solute carrier family 22 member 6 (423-431)
agaaccagccuggccgugcucggcaag

SEQ ID NO: 70749 - RNA, 27 nt, Artificial Sequence
  Actin-related protein 3 (290-298)
agaaccguggacgccaggcugaagcuc

SEQ ID NO: 70750 - RNA, 27 nt, Artificial Sequence
  Dolichyl-diphosphooligosaccharide-proteinosyltransferase subunit 1 (38-46)
agaaccguggaccugagcucccaccuc

SEQ ID NO: 70751 - RNA, 27 nt, Artificial Sequence
  Host cell factor 1 (1385-1393)
agaaccguggagagcggccuggaaguc

SEQ ID NO: 70752 - RNA, 39 nt, Artificial Sequence
  Myosin-9 (644-656)
agaaccgugggccagcuguacaaggagcaacucgccaaa

SEQ ID NO: 70753 - RNA, 24 nt, Artificial Sequence
  Probable C-mannosyltransferase DPY19L4 (518-525)
agaaccgugcaccccauccugcuc

SEQ ID NO: 70754 - RNA, 93 nt, Artificial Sequence
  Fructose-bisphosphate aldolase A (313-343)
agaaccgugcccccugccgucacaggcaucacuuuccugagcgggggacaguccgaggaagaggcuucuauuaaccucaaugcaauaaacaag

SEQ ID NO: 70755 - RNA, 39 nt, Artificial Sequence
  Programmed cell death protein 6 (100-112)
agaaccuacgacagggauaacagcggcaugaucgacaag

SEQ ID NO: 70756 - RNA, 27 nt, Artificial Sequence
  Chondroitin sulfate synthase 2 (347-355)
agaaccuaccaggagauccaagaacug

SEQ ID NO: 70757 - RNA, 27 nt, Artificial Sequence
  Vimentin (36-44)
agaaccuacagccugggcuccgcccuc

SEQ ID NO: 70758 - RNA, 27 nt, Artificial Sequence
  Mucolipin-1 (420-428)
agaguggcccugcccagcgucaugagg

SEQ ID NO: 70759 - RNA, 33 nt, Artificial Sequence
  Multiple epidermal growth factor-like domains protein 8 (2514-2524)
agaguggcccccgacaccggcguccacacaguu

SEQ ID NO: 70760 - RNA, 27 nt, Artificial Sequence
  Rab11 family-interacting protein 5 (210-218)
agaguggcccccccuagggcucugcuc

SEQ ID NO: 70761 - RNA, 39 nt, Artificial Sequence
  FUN14 domain-containing protein 1 (35-47)
agaguguucggccacagcuccgggcccauggucgagaag

SEQ ID NO: 70762 - RNA, 36 nt, Artificial Sequence
  Putative ATP-dependent RNA helicase DHX33 (247-258)
agaguguuccagggcgcccccaagggguacaggaaa

SEQ ID NO: 70763 - RNA, 33 nt, Artificial Sequence
  Annexin A1 (235-245)
agaguguuccagaaguacaccaaauauagcaag

SEQ ID NO: 70764 - RNA, 27 nt, Artificial Sequence
  Centrosomal protein C10orf90 (146-154)
agagugggccccccugccagggcucug

SEQ ID NO: 70765 - RNA, 27 nt, Artificial Sequence
  E3 ubiquitin-protein ligase MIB2 (385-393)
agagugaucggcgaccuggauaccguc

SEQ ID NO: 70766 - RNA, 39 nt, Artificial Sequence
  Protein FAM177A1 (56-68)
agagugauccacuucgucagcggcgagaccauggaagag

SEQ ID NO: 70767 - RNA, 39 nt, Artificial Sequence
  Glyceraldehyde-3-phosphate dehydrogenase (118-130)
agagugaucauuagcgcccccuccgcugacgcaccuaug

SEQ ID NO: 70768 - RNA, 30 nt, Artificial Sequence
  Nuclear valosin-containing protein-like (16-25)
agagugauccaguaccugaccagcaacaag

SEQ ID NO: 70769 - RNA, 30 nt, Artificial Sequence
  Translation initiation factor eIF-2B subunit alpha (136-145)
agagugcuggaggccgcugucgcagccaag

SEQ ID NO: 70770 - RNA, 30 nt, Artificial Sequence
  Ribosomal RNA-processing protein 8 (380-389)
agagugcugaagcccggcgggcuccuuaaa

SEQ ID NO: 70771 - RNA, 27 nt, Artificial Sequence
  Nidogen-2 (738-746)
agagugcugagguucgccgucaccaac

SEQ ID NO: 70772 - RNA, 27 nt, Artificial Sequence
  HLA class I histocompatibility antigen, Cw-3 alpha chain (2-10)
agagugauggcccccaggacccugauc

SEQ ID NO: 70773 - RNA, 27 nt, Artificial Sequence
  HLA class I histocompatibility antigen, Cw-2 alpha chain (2-10)
agagugauggcccccaggacccugcuc

SEQ ID NO: 70774 - RNA, 27 nt, Artificial Sequence
  Carbohydrate sulfotransferase 14 (126-134)
agagugaugaagguccuggccggcguu

SEQ ID NO: 70775 - RNA, 27 nt, Artificial Sequence
  Polycomb group RING finger protein 1 (90-98)
agagugaugcaggacaucgucuacaag

SEQ ID NO: 70776 - RNA, 33 nt, Artificial Sequence
  Spectrin alpha chain, non-erythrocytic 1 (204-214)
agagugaacgaggucaaucaguucgccgcuaag

SEQ ID NO: 70777 - RNA, 57 nt, Artificial Sequence
  Beta-2-microglobulin (80-98)
agagugaaccacgucacccugagccagcccaagaucguuaaaugggacagggauaug

SEQ ID NO: 70778 - RNA, 27 nt, Artificial Sequence
  Ribonuclease inhibitor (53-61)
agagugaaccccgcccuggcugagcuc

SEQ ID NO: 70779 - RNA, 27 nt, Artificial Sequence
  Major centromere autoantigen B (26-34)
agagugcagagccacauccugcaucuc

SEQ ID NO: 70780 - RNA, 27 nt, Artificial Sequence
  Mannose-1-phosphate guanyltransferase alpha (390-398)
agagugaggauccccgccgagguccug

SEQ ID NO: 70781 - RNA, 27 nt, Artificial Sequence
  Probable cation-transporting ATPase 13A2 (897-905)
agagugaggcccccuggcgcccugcuc

SEQ ID NO: 70782 - RNA, 27 nt, Artificial Sequence
  Transmembrane protein 121 (244-252)
agagugagcgccaucuucgucggcaag

SEQ ID NO: 70783 - RNA, 27 nt, Artificial Sequence
  Protein kinase C and casein kinase substrate in neurons protein 2 (92-100)
agagugagcgagcugcaccucgaaguc

SEQ ID NO: 70784 - RNA, 27 nt, Artificial Sequence
  Ectonucleoside triphosphate diphosphohydrolase 6 (359-367)
agagugagcgagguccugcagaacagg

SEQ ID NO: 70785 - RNA, 27 nt, Artificial Sequence
  HLA class I histocompatibility antigen, B-15 alpha chain (2-10)
agagugaccgcccccaggacaguccug

SEQ ID NO: 70786 - RNA, 30 nt, Artificial Sequence
  F-box/LRR-repeat protein 7 (354-363)
agagugaccgacgucggcaucagguacguu

SEQ ID NO: 70787 - RNA, 33 nt, Artificial Sequence
  Titin (16492-16502)
agagugaccggccugaucgagaaccacgacuac

SEQ ID NO: 70788 - RNA, 27 nt, Artificial Sequence
  Phospholipid transfer protein (25-33)
agagugaccagcaaggcccuggagcuc

SEQ ID NO: 70789 - RNA, 27 nt, Artificial Sequence
  UPF0769 protein C21orf59 (33-41)
agaguguacaacggcaggcugaagguc

SEQ ID NO: 70790 - RNA, 54 nt, Artificial Sequence
  HLA class I histocompatibility antigen, A-2 alpha chain (272-289)
agaugggagcccagcucccagccuaccaucccaauugugggcauaaucgccggg

SEQ ID NO: 70791 - RNA, 51 nt, Artificial Sequence
  HLA class I histocompatibility antigen, Cw-17 alpha chain (297-313)
agauggggcgggaagggagguagcugcucccaggccgcuucuucaaacagu

SEQ ID NO: 70792 - RNA, 27 nt, Artificial Sequence
  Calpain-3 (104-112)
agauacgccgacaagcacaugaacauc

SEQ ID NO: 70793 - RNA, 27 nt, Artificial Sequence
  Tetratricopeptide repeat protein 30A (26-34)
agauacgccgaggcugugcagcugcuc

SEQ ID NO: 70794 - RNA, 24 nt, Artificial Sequence
  Sodium/potassium-transporting ATPase subunit alpha-1 (276-283)
agauacgccaagaucguggagauu

SEQ ID NO: 70795 - RNA, 30 nt, Artificial Sequence
  Sodium/potassium-transporting ATPase subunit alpha-1 (276-285)
agauacgccaagaucguggagauucccuuc

SEQ ID NO: 70796 - RNA, 27 nt, Artificial Sequence
  Zinc finger and BTB domain-containing protein 11 (581-589)
agauacgcccugaucaugcacaagcuc

SEQ ID NO: 70797 - RNA, 30 nt, Artificial Sequence
  Bestrophin-1 (70-79)
agauacgccaaccugggcaaugugcucauc

SEQ ID NO: 70798 - RNA, 27 nt, Artificial Sequence
  Probable helicase with zinc finger domain (214-222)
agauacgccagcaggcugaucaagcuc

SEQ ID NO: 70799 - RNA, 27 nt, Artificial Sequence
  (Pyruvate dehydrogenase (acetyl-transferring))-phosphatase 1, mitochondrial (106-114)
agauacgccagcaccccccagaaguuc

SEQ ID NO: 70800 - RNA, 27 nt, Artificial Sequence
  Kelch-like protein 20 (384-392)
agauacgaccccaagaccaaccagugg

SEQ ID NO: 70801 - RNA, 27 nt, Artificial Sequence
  Kelch-like protein 20 (337-345)
agauacgacccccagaccaacgagugg

SEQ ID NO: 70802 - RNA, 27 nt, Artificial Sequence
  Protein FAM91A1 (437-445)
agauacuucgaccacgcccugacccuc

SEQ ID NO: 70803 - RNA, 27 nt, Artificial Sequence
  Heterogeneous nuclear ribonucleoprotein H2 (275-283)
agauacggcgacgggggaagcuccuuc

SEQ ID NO: 70804 - RNA, 27 nt, Artificial Sequence
  Transmembraneoprotein NMB (373-381)
agauacggccacuuccaggccaccauc

SEQ ID NO: 70805 - RNA, 24 nt, Artificial Sequence
  Protocadherin gamma-A11 (881-888)
agauacggcccccaguucacccug

SEQ ID NO: 70806 - RNA, 27 nt, Artificial Sequence
  Melanocyte protein PMEL (486-494)
agauacggcagcuucuccgugacccug

SEQ ID NO: 70807 - RNA, 27 nt, Artificial Sequence
  FTS and Hook-interacting protein (249-257)
agauacaucgccgaccacagcuauuuc

SEQ ID NO: 70808 - RNA, 27 nt, Artificial Sequence
  Hemicentin-1 (697-705)
agauacaucgaggcccccaagcugaug

SEQ ID NO: 70809 - RNA, 33 nt, Artificial Sequence
  Leucine-rich repeat LGI family member 3 (441-451)
agauacaucggcgacagcaagauucugaggugg

SEQ ID NO: 70810 - RNA, 27 nt, Artificial Sequence
  DNA repair protein RAD50 (184-192)
agauacaucaaggcccuggagacccuc

SEQ ID NO: 70811 - RNA, 30 nt, Artificial Sequence
  1,2-dihydroxy-3-keto-5-methylthiopentene dioxygenase (96-105)
agauacauccuggacggcagcggguauuuc

SEQ ID NO: 70812 - RNA, 27 nt, Artificial Sequence
  Serine/threonine-protein phosphatase 4 regulatory subunit 3B (575-583)
agauacaucaccaagggcaaccuguuc

SEQ ID NO: 70813 - RNA, 27 nt, Artificial Sequence
  HLA class II histocompatibility antigen, DP beta 1 chain (22-30)
agauacaucuauaacagggaggaauuc

SEQ ID NO: 70814 - RNA, 27 nt, Artificial Sequence
  Unconventional myosin-XVIIIa (834-842)
agauacaaggaggaaaacaucgagcug

SEQ ID NO: 70815 - RNA, 27 nt, Artificial Sequence
  Tubulin polyglutamylase TTLL4 (750-758)
agauaccugcacaagcccuaucucauc

SEQ ID NO: 70816 - RNA, 27 nt, Artificial Sequence
  Zinc finger protein 45 (95-103)
agauaccugccccacgaggaacucuuc

SEQ ID NO: 70817 - RNA, 27 nt, Artificial Sequence
  Leucine-rich repeat flightless-interacting protein 2 (360-368)
agauacaugcagggccugaaggagcuc

SEQ ID NO: 70818 - RNA, 24 nt, Artificial Sequence
  60S ribosomal protein L28 (39-46)
agauacaacggccugauccacagg

SEQ ID NO: 70819 - RNA, 27 nt, Artificial Sequence
  Leucine-rich repeat transmembrane neuronal protein 3 (444-452)
agauaccccgccagcaugaagcagcug

SEQ ID NO: 70820 - RNA, 27 nt, Artificial Sequence
  Serine/threonine-protein phosphatase 2A catalytic subunit beta isoform (106-114)
agauaccccgagaggaucaccauucug

SEQ ID NO: 70821 - RNA, 27 nt, Artificial Sequence
  SPRY domain-containing protein 3 (41-49)
agauaccaggagagguucaagcacauc

SEQ ID NO: 70822 - RNA, 27 nt, Artificial Sequence
  Cation-independent mannose-6-phosphate receptor (1386-1394)
agauacagcgacaacugggaggccauc

SEQ ID NO: 70823 - RNA, 27 nt, Artificial Sequence
  Phosphatidylcholine translocator ABCB4 (47-55)
agauacagcgacuggcaggauaagcug

SEQ ID NO: 70824 - RNA, 30 nt, Artificial Sequence
  Phosphatidylinositol 3-kinase catalytic subunit type 3 (811-820)
agauacagcaaccugauccucaaucuuuuc

SEQ ID NO: 70825 - RNA, 30 nt, Artificial Sequence
  E3 ubiquitin-protein ligase UBR2 (462-471)
agauacaccgcccugcaggcuuucaaguuu

SEQ ID NO: 70826 - RNA, 27 nt, Artificial Sequence
  DnaJ homolog subfamily C member 3 (283-291)
agauacaccgacgccacaagcaaguau

SEQ ID NO: 70827 - RNA, 36 nt, Artificial Sequence
  E3 ubiquitin-protein ligase HUWE1 (156-167)
agauacaccgacauggagagcgaagauuaucacuuc

SEQ ID NO: 70828 - RNA, 27 nt, Artificial Sequence
  Ubiquitin carboxyl-terminal hydrolase 13 (490-498)
agauacaccgagaggguggacuaucug

SEQ ID NO: 70829 - RNA, 27 nt, Artificial Sequence
  Cullin-1 (190-198)
agauacacccugcaggccagcacauuc

SEQ ID NO: 70830 - RNA, 27 nt, Artificial Sequence
  Serine/threonine-protein kinase SMG1 (1394-1402)
agauacaccauguaucagaaccaacug

SEQ ID NO: 70831 - RNA, 24 nt, Artificial Sequence
  Rho guanine nucleotide exchange factor 2 (8-15)
agauacaccaacggccaccuguuc

SEQ ID NO: 70832 - RNA, 33 nt, Artificial Sequence
  Rho guanine nucleotide exchange factor 2 (8-18)
agauacaccaacggccaccuguucacaacuauc

SEQ ID NO: 70833 - RNA, 27 nt, Artificial Sequence
  Cyclin-dependent kinase 9 (184-192)
agauacaccaacaggguggucacacug

SEQ ID NO: 70834 - RNA, 27 nt, Artificial Sequence
  Chloride channel protein 2 (25-33)
agauacacccaggaccugggcgccuuc

SEQ ID NO: 70835 - RNA, 27 nt, Artificial Sequence
  CDK5 regulatory subunit-associated protein 3 (428-436)
agauacguggacagggucaccgaguuc

SEQ ID NO: 70836 - RNA, 27 nt, Artificial Sequence
  Protein orai-3 (145-153)
agauacguggagcuggccuggggcuuc

SEQ ID NO: 70837 - RNA, 27 nt, Artificial Sequence
  Eukaryotic translation initiation factor 2 subunit 1 (234-242)
agauacgugaugaccacaacuacgcug

SEQ ID NO: 70838 - RNA, 39 nt, Artificial Sequence
  HLA class I histocompatibility antigen, B-51 alpha chain (82-94)
agauacuauaaccagagcgaggccggcucccacaccugg

SEQ ID NO: 70839 - RNA, 27 nt, Artificial Sequence
  Homeodomain-interacting protein kinase 2 (365-373)
agauacuauagggcccccgagaucauu

SEQ ID NO: 70840 - RNA, 27 nt, Artificial Sequence
  Glycogen synthase kinase-3 beta (220-228)
agauacuauagggcccccgagcugauc

SEQ ID NO: 70841 - RNA, 42 nt, Artificial Sequence
  Motor neuron and pancreas homeobox protein 1 (169-182)
agcgccgcugcagccgcggcugcccuggcaggccagcacccc

SEQ ID NO: 70842 - RNA, 33 nt, Artificial Sequence
  AT-rich interactive domain-containing protein 1B (270-280)
agcgccgcugcagccggcgcgcccggguccaug

SEQ ID NO: 70843 - RNA, 27 nt, Artificial Sequence
  Beta-2-syntrophin (491-499)
agcgccgacgauggcaucagaaaccug

SEQ ID NO: 70844 - RNA, 30 nt, Artificial Sequence
  Eukaryotic translation initiation factor 3 subunit K (79-88)
agcgccgacgaguccggccagaucuucauu

SEQ ID NO: 70845 - RNA, 81 nt, Artificial Sequence
  Filamin-B (567-593)
agcgccgacuucguggucgaguccaucggcucugaaguugggucacugggauuugcuauugagggucccagucaggcaaag

SEQ ID NO: 70846 - RNA, 24 nt, Artificial Sequence
  COMM domain-containing protein 4 (177-184)
agcgccgacaaguuccaggugcug

SEQ ID NO: 70847 - RNA, 27 nt, Artificial Sequence
  COMM domain-containing protein 4 (177-185)
agcgccgacaaguuccaggugcugcuc

SEQ ID NO: 70848 - RNA, 24 nt, Artificial Sequence
  Transcription factor MafF (16-23)
agcgccgaggaagugaccagacug

SEQ ID NO: 70849 - RNA, 27 nt, Artificial Sequence
  E3 SUMO-protein ligase RanBP2 (993-1001)
agcgccgaguccaagaccaucgaauuc

SEQ ID NO: 70850 - RNA, 27 nt, Artificial Sequence
  Mucin-19 (2343-2351)
agcgccgagguguccggcagaaucgaa

SEQ ID NO: 70851 - RNA, 51 nt, Artificial Sequence
  Cytochrome c oxidase subunit 7C, mitochondrial (47-63)
agcgccuucgcuacccccuuucugguggucagacaccagcuccuuaagaca

SEQ ID NO: 70852 - RNA, 27 nt, Artificial Sequence
  Ankyrin repeat and KH domain-containing protein 1 (2266-2274)
agcgccuuccugggcaacuccgugcuc

SEQ ID NO: 70853 - RNA, 27 nt, Artificial Sequence
  AP-5 complex subunit mu-1 (88-96)
agcgccuucuccggccccuacaaguuu

SEQ ID NO: 70854 - RNA, 93 nt, Artificial Sequence
  PR domain zinc finger protein 8 (458-488)
agcgccuucaccuccgugccccagcugggcucugcugggucaacaaguggagguggcgggacuggagcaggcgccgcggguggggcuggaggc

SEQ ID NO: 70855 - RNA, 21 nt, Artificial Sequence
  Transmembrane emp24 domain-containing protein 10 (79-85)
agcgccggccacauccuguac

SEQ ID NO: 70856 - RNA, 48 nt, Artificial Sequence
  Laminin subunit gamma-1 (664-679)
agcgccggcuaccuggacgaugugacccucgcuuccgcaagacccggg

SEQ ID NO: 70857 - RNA, 51 nt, Artificial Sequence
  Laminin subunit gamma-1 (664-680)
agcgccggcuaccuggacgaugugacccucgcuuccgcaagacccgggccu

SEQ ID NO: 70858 - RNA, 54 nt, Artificial Sequence
  Laminin subunit gamma-1 (664-681)
agcgccggcuaccuggacgaugugacccucgcuuccgcaagacccgggccugga

SEQ ID NO: 70859 - RNA, 24 nt, Artificial Sequence
  Nuclear factor of activated T-cells, cytoplasmic 2 (354-361)
agcgcccacgagcugcccauggug

SEQ ID NO: 70860 - RNA, 27 nt, Artificial Sequence
  Armadillo repeat-containing protein 1 (96-104)
agcgccaucgcuuccaccaaggugaug

SEQ ID NO: 70861 - RNA, 27 nt, Artificial Sequence
  Tripeptidyl-peptidase 1 (315-323)
agcgcccugccccacgugcauaccguc

SEQ ID NO: 70862 - RNA, 42 nt, Artificial Sequence
  3-hydroxy-3-methylglutaryl-coenzyme A reductase (687-700)
agcgccauggcuggcuccaucgggggauacaacgcacacgcc

SEQ ID NO: 70863 - RNA, 27 nt, Artificial Sequence
  Phosphoglucomutase-1 (263-271)
agcgccaacgacaagguguacaccguc

SEQ ID NO: 70864 - RNA, 30 nt, Artificial Sequence
  WD repeat and FYVE domain-containing protein 3 (1236-1245)
agcgccaaccccccuguggucuccaccguu

SEQ ID NO: 70865 - RNA, 24 nt, Artificial Sequence
  Serine/threonine-protein phosphatase 2A regulatory subunit B'' subunit gamma (114-121)
agcgcccccuccgcucugagagug

SEQ ID NO: 70866 - RNA, 27 nt, Artificial Sequence
  Microtubule-associated protein 9 (372-380)
agcgccagacugaugaccuccgaguuc

SEQ ID NO: 70867 - RNA, 27 nt, Artificial Sequence
  Importin-5 (974-982)
agcgccgugggcaagaucaugaaauuc

SEQ ID NO: 70868 - RNA, 30 nt, Artificial Sequence
  Transcription factor SOX-10 (331-340)
agcgccuggaucuccaagcccccuggcgug

SEQ ID NO: 70869 - RNA, 27 nt, Artificial Sequence
  Nuclear export mediator factor NEMF (468-476)
agcgccuacgcuaacgcaaagaaauau

SEQ ID NO: 70870 - RNA, 24 nt, Artificial Sequence
  Zinc finger MYM-type protein 4 (449-456)
agcgccuacagagugaagaugguc

SEQ ID NO: 70871 - RNA, 27 nt, Artificial Sequence
  Small subunit processome component 20 homolog (1418-1426)
agcgacuucgaguccggccugaaguac

SEQ ID NO: 70872 - RNA, 21 nt, Artificial Sequence
  Fas apoptotic inhibitory molecule 1 (47-53)
agcgacggcgugcacaagauc

SEQ ID NO: 70873 - RNA, 21 nt, Artificial Sequence
  Fructose-bisphosphate aldolase A (272-278)
agcgaccaccauaucuaccug

SEQ ID NO: 70874 - RNA, 51 nt, Artificial Sequence
  Galectin-3-binding protein (311-327)
agcgaccuggccgugcccuccgagcucgcucuucugaaggcagucgauacc

SEQ ID NO: 70875 - RNA, 87 nt, Artificial Sequence
  HLA class I histocompatibility antigen, A-23 alpha chain (337-365)
agcgacagaaagggcggguccuacucucaggccgcuucaagugauagcgcacaaggauccgacgugucucugaccgccugcaaaguc

SEQ ID NO: 70876 - RNA, 48 nt, Artificial Sequence
  HLA class I histocompatibility antigen, A-23 alpha chain (350-365)
agcgacuccgcccagggcucugaugugucacugaccgcuugcaagguc

SEQ ID NO: 70877 - RNA, 27 nt, Artificial Sequence
  Immunoglobulin superfamily member 3 (355-363)
agcgacuccguguucguccugaagauc

SEQ ID NO: 70878 - RNA, 30 nt, Artificial Sequence; identical to SEQ ID NO: 46651
  HLA class I histocompatibility antigen, A-23 alpha chain (356-365)

SEQ ID NO: 70879 - RNA, 30 nt, Artificial Sequence
  Kelch repeat and BTB domain-containing protein 6 (137-146)
agcgaggccaacguggaaagacuguacgcu

SEQ ID NO: 70880 - RNA, 27 nt, Artificial Sequence
  YTH domain-containing family protein 1 (301-309)
agcgaggacgauauccacagauccauu

SEQ ID NO: 70881 - RNA, 27 nt, Artificial Sequence
  RNA-binding protein 28 (126-134)
agcgaggacgaucugaagaccguguuc

SEQ ID NO: 70882 - RNA, 27 nt, Artificial Sequence
  Sister chromatid cohesion protein PDS5 homolog A (59-67)
agcgaggacgaaaagcagcaauaccug

SEQ ID NO: 70883 - RNA, 27 nt, Artificial Sequence
  Hermansky-Pudlak syndrome 5 protein (476-484)
agcgaggacgaaagauucaaggaguuu

SEQ ID NO: 70884 - RNA, 27 nt, Artificial Sequence
  Ras-specific guanine nucleotide-releasing factor RalGPS2 (420-428)
agcgaggaccuggccgugcaccucuac

SEQ ID NO: 70885 - RNA, 30 nt, Artificial Sequence
  Peptidyl-prolyl cis-trans isomerase FKBP9 (197-206)
agcgaggaccaggugcaaauccacaccuac

SEQ ID NO: 70886 - RNA, 27 nt, Artificial Sequence
  WD repeat-containing protein 6 (258-266)
agcgaggacagauccgugaggaucugg

SEQ ID NO: 70887 - RNA, 27 nt, Artificial Sequence
  Thioredoxin-like protein 4A (20-28)
agcgaggaagacagaguggucguuauc

SEQ ID NO: 70888 - RNA, 27 nt, Artificial Sequence
  Vacuolar protein sorting-associated protein 41 homolog (24-32)
agcgaggaagagcccaagcugaaauac

SEQ ID NO: 70889 - RNA, 30 nt, Artificial Sequence
  Protocadherin Fat 1 (2947-2956)
agcgaggaaaucaacagacaggugaccuac

SEQ ID NO: 70890 - RNA, 27 nt, Artificial Sequence
  Thioredoxin-related transmembrane protein 2 (247-255)
agcgaggaaaacgugaucagagaguuc

SEQ ID NO: 70891 - RNA, 21 nt, Artificial Sequence
  26S proteasome non-ATPase regulatory subunit 13 (65-71)
agcgaguucgaacacagagug

SEQ ID NO: 70892 - RNA, 27 nt, Artificial Sequence
  Protein PRR14L (1206-1214)
agcgaguucggcaaggaauccaccuuu

SEQ ID NO: 70893 - RNA, 30 nt, Artificial Sequence
  Aldehyde dehydrogenase family 1 member A3 (328-337)
agcgaguucgugagaagguccgucgaauac

SEQ ID NO: 70894 - RNA, 27 nt, Artificial Sequence
  Alpha-parvin (149-157)
agcgagaucgcccagaagcaaaaacug

SEQ ID NO: 70895 - RNA, 30 nt, Artificial Sequence
  Microtubule cross-linking factor 1 (653-662)
agcgagaucgaagaccacaacagacagcug

SEQ ID NO: 70896 - RNA, 27 nt, Artificial Sequence
  Protein AHNAK2 (1652-1660)
agcgagaucgaaggcaacgugaccuuc

SEQ ID NO: 70897 - RNA, 30 nt, Artificial Sequence
  Manganese-transporting ATPase 13A1 (95-104)
agcgagaucagagccgcugaaaagaaauuc

SEQ ID NO: 70898 - RNA, 27 nt, Artificial Sequence
  Vesicle transport protein USE1 (81-89)
agcgagaaggcccuggcuaaccaguuc

SEQ ID NO: 70899 - RNA, 30 nt, Artificial Sequence
  Centromere protein F (130-139)
agcgagcuggacaagcuccuuuccucuuuc

SEQ ID NO: 70900 - RNA, 36 nt, Artificial Sequence
  Proline-rich protein 12 (622-633)
agcgagcugcucgccggccccgggggaccuccagcu

SEQ ID NO: 70901 - RNA, 30 nt, Artificial Sequence
  LisH domain-containing protein ARMC9 (9-18)
agcgagcugcucggccuugugaaggaauac

SEQ ID NO: 70902 - RNA, 27 nt, Artificial Sequence
  T-box transcription factor TBX3 (698-706)
agcgagcugcaguccauccaaagacuc

SEQ ID NO: 70903 - RNA, 27 nt, Artificial Sequence
  Sal-like protein 1 (1206-1214)
agcgagaacggcaccaauuucagauuu

SEQ ID NO: 70904 - RNA, 105 nt, Artificial Sequence
  Glia-derived nexin (342-376)
agcgagaaccugcacgugucccauauccuccagaaggccaaaauugaagucucugaggacggcaccaaggcuucagcagccacaacugcgauacuuaucgcuaga

SEQ ID NO: 70905 - RNA, 27 nt, Artificial Sequence
  H/ACA ribonucleoprotein complex subunit 1 (130-138)
agcgagaacaugaaggccuccucuuuc

SEQ ID NO: 70906 - RNA, 27 nt, Artificial Sequence
  Plectin (3824-3832)
agcgagcccuccgaagugagaucuuac

SEQ ID NO: 70907 - RNA, 27 nt, Artificial Sequence
  Integrin alpha-3 (534-542)
agcgaguccgccguguuccacggcuuu

SEQ ID NO: 70908 - RNA, 30 nt, Artificial Sequence
  Arfaptin-1 (44-53)
agcgagacccagaucacaucccacggcuuc

SEQ ID NO: 70909 - RNA, 27 nt, Artificial Sequence
  Laminin subunit gamma-1 (617-625)
agcgagaccacagugaaguacgucuuc

SEQ ID NO: 70910 - RNA, 27 nt, Artificial Sequence
  Plexin-B2 (30-38)
agcgagaccguggucgaaagaaugcug

SEQ ID NO: 70911 - RNA, 30 nt, Artificial Sequence
  U5 small nuclear ribonucleoprotein 200 kDa helicase (1230-1239)
agcgaggugauccugcaccaugaauacuuc

SEQ ID NO: 70912 - RNA, 24 nt, Artificial Sequence
  Eukaryotic translation initiation factor 3 subunit D (444-451)
agcgaguaccugaagcucggcuau

SEQ ID NO: 70913 - RNA, 27 nt, Artificial Sequence
  Homeobox protein Hox-D9 (57-65)
agcuucgcccccagauccgcuguguuu

SEQ ID NO: 70914 - RNA, 27 nt, Artificial Sequence
  Renin receptor (256-264)
agcuucgacaccucccugaucagaaag

SEQ ID NO: 70915 - RNA, 24 nt, Artificial Sequence
  Liprin-beta-1 (507-514)
agcuucggcagaggguuuuucaag

SEQ ID NO: 70916 - RNA, 27 nt, Artificial Sequence
  Zinc finger protein 697 (92-100)
agcuucauccaguccucucaccugauu

SEQ ID NO: 70917 - RNA, 30 nt, Artificial Sequence
  High affinity cationic amino acid transporter 1 (57-66)
agcuuccugaucgccgcucucgcauccgug

SEQ ID NO: 70918 - RNA, 24 nt, Artificial Sequence
  Immediate early response gene 5 protein (276-283)
agcuucuccggccugcucagaaag

SEQ ID NO: 70919 - RNA, 27 nt, Artificial Sequence
  Zinc finger protein 175 (287-295)
agcuucacccagaagucccaccuguuu

SEQ ID NO: 70920 - RNA, 69 nt, Artificial Sequence
  Eukaryotic peptide chain release factor GTP-binding subunit ERF3A (163-185)
agcuucgugcccaacaugaucggcggggccucccaggcugaccuggcaguccucguuauuucugccaga

SEQ ID NO: 70921 - RNA, 42 nt, Artificial Sequence
  Protein HEG homolog 1 (148-161)
agcggcgacuuccagaugucccccuacgccgaguauccuaag

SEQ ID NO: 70922 - RNA, 51 nt, Artificial Sequence
  Protein HEG homolog 1 (148-164)
agcggcgacuuccagaugucccccuacgccgaguauccuaagaacccaaga

SEQ ID NO: 70923 - RNA, 27 nt, Artificial Sequence
  Trabeculin-alpha (4239-4247)
agcggcgaccccaaggugaucgagguc

SEQ ID NO: 70924 - RNA, 27 nt, Artificial Sequence
  Nicastrin (47-55)
agcggcgacaccggggugauccacguc

SEQ ID NO: 70925 - RNA, 27 nt, Artificial Sequence
  Bifunctional apoptosis regulator (310-318)
agcggcgaggacaucgugaccaagcug

SEQ ID NO: 70926 - RNA, 66 nt, Artificial Sequence
  Beta-enolase (330-351)
agcggcgagaccgaagacacauucaucgccgaucugguggucgggcucugcacuggacagauuaag

SEQ ID NO: 70927 - RNA, 54 nt, Artificial Sequence
  Putative ATP-dependent RNA helicase DHX57 (36-53)
agcggcgggggagguggcgggggaggcggugggggaggcggcaacagaaaggcc

SEQ ID NO: 70928 - RNA, 39 nt, Artificial Sequence
  Signal recognition particle subunit SRP68 (27-39)
agcggcgggggaagaggugccggcggggaggaaaacaag

SEQ ID NO: 70929 - RNA, 27 nt, Artificial Sequence
  Elongation factor 2 (418-426)
agcggccugguguccaccgggcucaag

SEQ ID NO: 70930 - RNA, 27 nt, Artificial Sequence
  ATP-dependent RNA helicase DDX39A (90-98)
agcggcauggggaagaccgccguguuc

SEQ ID NO: 70931 - RNA, 45 nt, Artificial Sequence
  Collagen alpha-1(III) chain (60-74)
agcggccccaagggggacgccggacagccuggugagaaaggcucc

SEQ ID NO: 70932 - RNA, 48 nt, Artificial Sequence
  Phosphatidylethanolamine-binding protein 1 (9-24)
agcggcccccugucccuccaggagguggacgaacaaccucagcaccca

SEQ ID NO: 70933 - RNA, 42 nt, Artificial Sequence
  Laminin subunit alpha-4 (576-589)
agccacgaccuggugcaggaggccaucgaucaugcucaagac

SEQ ID NO: 70934 - RNA, 30 nt, Artificial Sequence
  Protein phosphatase 1J (227-236)
agccacgagucccugguggucggcgccguu

SEQ ID NO: 70935 - RNA, 30 nt, Artificial Sequence; identical to SEQ ID NO: 46708
  Protein unc-93 homolog B1 (264-273)

SEQ ID NO: 70936 - RNA, 27 nt, Artificial Sequence
  Plasma protease C1 inhibitor (350-358)
agccacaaccugucccucgugauccuu

SEQ ID NO: 70937 - RNA, 21 nt, Artificial Sequence
  Protein phosphatase 1 regulatory subunit 3F (177-183)
agccacccccugggcauccuc

SEQ ID NO: 70938 - RNA, 54 nt, Artificial Sequence
  Cytochrome c oxidase subunit 7C, mitochondrial (17-34)
agccacuacgaggaaggccccgggaagaaccugccuuucuccguggagaauaaa

SEQ ID NO: 70939 - RNA, 69 nt, Artificial Sequence
  Cytochrome c oxidase subunit 7C, mitochondrial (17-39)
agccacuacgaggaaggccccgggaagaaccugccuuucuccguggagaauaaauggucucuccuugcc

SEQ ID NO: 70940 - RNA, 141 nt, Artificial Sequence
  Cytochrome c oxidase subunit 7C, mitochondrial (17-63)
agccacuacgaggaaggccccgggaagaaccugccuuucuccguggagaauaaauggucucuccuugccaagaugugccuguauuuuggaucagcuuucgcaaccccauuuuuggucguuagacaucaguuacugaaaaca

SEQ ID NO: 70941 - RNA, 27 nt, Artificial Sequence
  Clustered mitochondria protein homolog (225-233)
agcaucgacuucggcaagaccgugguc

SEQ ID NO: 70942 - RNA, 27 nt, Artificial Sequence
  Charged multivesicular body protein 5 (30-38)
agcaucgacaagaaaauuuccagacug

SEQ ID NO: 70943 - RNA, 27 nt, Artificial Sequence
  Nodal modulator 3 (272-280)
agcaucgacuccgagcccgcccuggug

SEQ ID NO: 70944 - RNA, 27 nt, Artificial Sequence
  Eukaryotic translation initiation factor 4 gamma 1 (1038-1046)
agcaucgacuccaacaaucagcuguuc

SEQ ID NO: 70945 - RNA, 30 nt, Artificial Sequence; identical to SEQ ID NO: 46718
  Vacuolar protein sorting-associated protein 13B (1953-1962)

SEQ ID NO: 70946 - RNA, 27 nt, Artificial Sequence
  Transmembrane channel-like protein 4 (391-399)
agcaucuucauugccggcgugaacuuu

SEQ ID NO: 70947 - RNA, 27 nt, Artificial Sequence
  Nischarin (214-222)
agcaucuucaagucccugcaccaggug

SEQ ID NO: 70948 - RNA, 27 nt, Artificial Sequence
  Adenylate kinase 9 (1441-1449)
agcaucggcggggcccugagauacgug

SEQ ID NO: 70949 - RNA, 27 nt, Artificial Sequence
  Protein ELYS (1701-1709)
agcauccacgagaccauuccccuggug

SEQ ID NO: 70950 - RNA, 27 nt, Artificial Sequence
  Hom s 5 (332-340)
agcaucauugccgaggugaaggcucag

SEQ ID NO: 70951 - RNA, 30 nt, Artificial Sequence
  Zinc finger E-box-binding homeobox 2 (500-509)
agcaucauugacuacacccuggagaaggug

SEQ ID NO: 70952 - RNA, 30 nt, Artificial Sequence
  Poly(rC)-binding protein 2 (27-36)
agcaucauuggcaagaaaggggaguccgug

SEQ ID NO: 70953 - RNA, 165 nt, Artificial Sequence
  6.8 kDa mitochondrial proteolipid (4-58)
agcaucauuaagaacauauggauccccaugaaaccuuacuauaccaagguguaccaggagauuuggaucggcauggggcugaugggauucauugucuauaaaaucagagccgcugacaagagguccaaagcacucaaggccucugcgccagcuccgggucaccau

SEQ ID NO: 70954 - RNA, 27 nt, Artificial Sequence
  Neuron navigator 2 (1370-1378)
agcaucauucccuaccugcucgaggcc

SEQ ID NO: 70955 - RNA, 27 nt, Artificial Sequence
  Protein transport protein Sec23B (625-633)
agcauccuggccgacagaauucuccuu

SEQ ID NO: 70956 - RNA, 27 nt, Artificial Sequence
  Raftlin-2 (58-66)
agcauccuggacauugugaccaagguc

SEQ ID NO: 70957 - RNA, 27 nt, Artificial Sequence
  Tripartite motif-containing protein 2 (120-128)
agcauccuggagaccgugacagccguc

SEQ ID NO: 70958 - RNA, 27 nt, Artificial Sequence
  N6-adenosine-methyltransferase 70 kDa subunit (384-392)
agcauccugggcaaguucgccgugguc

SEQ ID NO: 70959 - RNA, 69 nt, Artificial Sequence
  Heat shock cognate 71 kDa protein (362-384)
agcaucaaccccgacgaggccguggcuuacggcgcagccguccaggcggcuauucuguccggggauaag

SEQ ID NO: 70960 - RNA, 27 nt, Artificial Sequence
  Eukaryotic translation initiation factor 4 gamma 1 (244-252)
agcauccccggcgacaccaugacaacu

SEQ ID NO: 70961 - RNA, 27 nt, Artificial Sequence
  Cyclic AMP-dependent transcription factor ATF-6 alpha (178-186)
agcauccagcccaagccucugcuccuu

SEQ ID NO: 70962 - RNA, 27 nt, Artificial Sequence
  E3 ubiquitin-protein ligase UBR5 (550-558)
agcaucuccgccggcauucccaaggug

SEQ ID NO: 70963 - RNA, 27 nt, Artificial Sequence
  Tuberin (341-349)
agcaucaccagacugauuaagaaauac

SEQ ID NO: 70964 - RNA, 27 nt, Artificial Sequence
  ATP-dependent DNA helicase Q1 (13-21)
agcaucaccuccgagcugcacgccgug

SEQ ID NO: 70965 - RNA, 30 nt, Artificial Sequence
  Alpha-2-macroglobulin (161-170)
agcaucuacaagcccggccagaccgugaaa

SEQ ID NO: 70966 - RNA, 63 nt, Artificial Sequence
  Heat shock protein HSP 90-beta (408-428)
agcaucuacuauauuaccggcgaguccaaggaacagguggccaacucugcuuucgucgagaga

SEQ ID NO: 70967 - RNA, 27 nt, Artificial Sequence
  Pre-mRNA-processing-splicing factor 8 (1179-1187)
agcaaggacaaccccaaucugcucuuc

SEQ ID NO: 70968 - RNA, 24 nt, Artificial Sequence
  Histone-lysine N-methyltransferase SETDB1 (427-434)
agcaagggccccgugguccaguac

SEQ ID NO: 70969 - RNA, 21 nt, Artificial Sequence
  Histone deacetylase 1 (88-94)
agcaagcagaugcaaagauuc

SEQ ID NO: 70970 - RNA, 27 nt, Artificial Sequence
  AT-rich interactive domain-containing protein 1A (1821-1829)
agccuggccgcuagagcaaucgccgug

SEQ ID NO: 70971 - RNA, 39 nt, Artificial Sequence
  Tenascin (1578-1590)
agccuggccgaccucucccccucuacccacuacacagcu

SEQ ID NO: 70972 - RNA, 33 nt, Artificial Sequence
  Integrin alpha-7 (461-471)
agccuggccgacaccgcugugcucuucagagca

SEQ ID NO: 70973 - RNA, 33 nt, Artificial Sequence
  Melanocyte protein PMEL (577-587)
agccuggccgacaccaacucccucgcugugguc

SEQ ID NO: 70974 - RNA, 27 nt, Artificial Sequence
  Sestrin-2 (190-198)
agccuggccgagcucauccaggcucuu

SEQ ID NO: 70975 - RNA, 27 nt, Artificial Sequence
  Fatty acid synthase (2500-2508)
agccuggccgagcccagaguguccguc

SEQ ID NO: 70976 - RNA, 33 nt, Artificial Sequence
  Ankyrin-2 (84-94)
agccuggccggccaggcugagguggucaagguu

SEQ ID NO: 70977 - RNA, 27 nt, Artificial Sequence
  Putative WAS protein family homolog 3 (9-17)
agccuggccggccagaccuacgcugug

SEQ ID NO: 70978 - RNA, 27 nt, Artificial Sequence
  Transmembrane protein 25 isoform 5 (201-209)
agccuggcccacaaccucuccgugguc

SEQ ID NO: 70979 - RNA, 30 nt, Artificial Sequence
  T-complex protein 1 subunit beta (5-14)
agccuggcccccgugaacaucuucaaggcu

SEQ ID NO: 70980 - RNA, 30 nt, Artificial Sequence
  Hermansky-Pudlak syndrome 4 protein (570-579)
agccuggccucccucaacggccuugaggug

SEQ ID NO: 70981 - RNA, 27 nt, Artificial Sequence
  Inversin (13-21)
agccuggccucccaggugcacgcugca

SEQ ID NO: 70982 - RNA, 30 nt, Artificial Sequence
  Serine/threonine-protein kinase SMG1 (1090-1099)
agccuggccuccgugaucauuucugcucuc

SEQ ID NO: 70983 - RNA, 27 nt, Artificial Sequence
  Unconventional myosin-Ic (701-709)
agccuggccaccaagauccaggcugca

SEQ ID NO: 70984 - RNA, 27 nt, Artificial Sequence
  Growth factor receptor-bound protein 10 (498-506)
agccuggacgauggcaacaccaaguuc

SEQ ID NO: 70985 - RNA, 33 nt, Artificial Sequence
  L-dopachrome tautomerase (288-298)
agccuggacgauuacaaccaccucgugacccuu

SEQ ID NO: 70986 - RNA, 30 nt, Artificial Sequence
  Proline-rich protein 12 (709-718)
agccuggacgagggcgccaccgcugcacuc

SEQ ID NO: 70987 - RNA, 27 nt, Artificial Sequence
  Heat shock protein 105 kDa (204-212)
agccuggacgagaagcccagaaucgug

SEQ ID NO: 70988 - RNA, 27 nt, Artificial Sequence
  Adenomatous polyposis coli protein (1410-1418)
agccuggacgagcccuucauccagaag

SEQ ID NO: 70989 - RNA, 30 nt, Artificial Sequence
  Sister chromatid cohesion protein PDS5 homolog A (493-502)
agccuggaccccaacgccgugaaggcucuc

SEQ ID NO: 70990 - RNA, 27 nt, Artificial Sequence
  Regulator of G-protein signaling 20 (174-182)
agccuggacuccagagugagggagguc

SEQ ID NO: 70991 - RNA, 27 nt, Artificial Sequence
  Protein AHNAK2 (497-505)
agccuggacguguccgcccccaagguc

SEQ ID NO: 70992 - RNA, 33 nt, Artificial Sequence
  Importin subunit alpha-4 (6-16)
agccuggagaaccacagaaucaaguccuucaaa

SEQ ID NO: 70993 - RNA, 27 nt, Artificial Sequence
  mRNA cap guanine-N7 methyltransferase (14-22)
agccuggagcaggccaaggcuuccgug

SEQ ID NO: 70994 - RNA, 30 nt, Artificial Sequence
  Cytokine receptor common subunit beta (667-676)
agccuggaguccggcgggggacccgccccu

SEQ ID NO: 70995 - RNA, 27 nt, Artificial Sequence
  G-protein coupled receptor 56 (216-224)
agccuggaguccaagcucaccucugug

SEQ ID NO: 70996 - RNA, 36 nt, Artificial Sequence
  Tetratricopeptide repeat protein 28 (808-819)
agccuguucgaccuccagaccuccucuuaccaagcc

SEQ ID NO: 70997 - RNA, 30 nt, Artificial Sequence; identical to SEQ ID NO: 46770
  WD repeat-containing protein 27 (376-385)

SEQ ID NO: 70998 - RNA, 21 nt, Artificial Sequence
  Four and a half LIM domains protein 2 (123-129)
agccuguucggcaagaaauac

SEQ ID NO: 70999 - RNA, 27 nt, Artificial Sequence
  Four and a half LIM domains protein 2 (123-131)
agccuguucggcaagaaauacauccuc

SEQ ID NO: 71000 - RNA, 27 nt, Artificial Sequence
  Mannosyl-oligosaccharide 1,2-alpha-mannosidase IA (231-239)
agccuguucggcaacaucaagggggcc

SEQ ID NO: 71001 - RNA, 27 nt, Artificial Sequence
  Plectin (6-14)
agccuguuccccucccucguggucguu

SEQ ID NO: 71002 - RNA, 39 nt, Artificial Sequence
  GPI transamidase component PIG-T (490-502)
agccuguuccccguguccgacggcucuaacuacuuuguc

SEQ ID NO: 71003 - RNA, 27 nt, Artificial Sequence
  Hsp90 co-chaperone Cdc37 (27-35)
agccuguucagauggaggcaccaggcc

SEQ ID NO: 71004 - RNA, 27 nt, Artificial Sequence
  Zinc finger MYM-type protein 3 (596-604)
agccuguucuccggcaagcccgaggug

SEQ ID NO: 71005 - RNA, 27 nt, Artificial Sequence
  Uracil phosphoribosyltransferase homolog (268-276)
agccuguucuccaccccccacggcgcc

SEQ ID NO: 71006 - RNA, 30 nt, Artificial Sequence
  Formin-like protein 2 (880-889)
agccuguucuacaacgagcuccacuaugug

SEQ ID NO: 71007 - RNA, 27 nt, Artificial Sequence
  Cation-independent mannose-6-phosphate receptor (2149-2157)
agccugggcgacaucuacuucaagcuc

SEQ ID NO: 71008 - RNA, 27 nt, Artificial Sequence
  Dynein heavy chain domain-containing protein 1 (1476-1484)
agccugggcgaggcccucaagcagcuu

SEQ ID NO: 71009 - RNA, 27 nt, Artificial Sequence
  Neuroblast differentiation-associated protein AHNAK (969-977)
agccugggcgaggggcaccucuccgug

SEQ ID NO: 71010 - RNA, 24 nt, Artificial Sequence
  TBC1 domain family member 4 (1089-1096)
agccugggcuucguggccagaguc

SEQ ID NO: 71011 - RNA, 30 nt, Artificial Sequence; identical to SEQ ID NO: 46784
  Caspase-4 (16-25)

SEQ ID NO: 71012 - RNA, 24 nt, Artificial Sequence
  Solute carrier family 26 member 6 (325-332)
agccugggcaagaucuucgcccuc

SEQ ID NO: 71013 - RNA, 24 nt, Artificial Sequence
  Circadian clock protein PASD1 (699-706)
agccugggccccgugguccagguu

SEQ ID NO: 71014 - RNA, 24 nt, Artificial Sequence
  Vesicular glutamate transporter 2 (23-30)
agccugggccagaucuacagagug

SEQ ID NO: 71015 - RNA, 27 nt, Artificial Sequence
  Cathepsin K (65-73)
agccugggcgugcacaccuacgagcuc

SEQ ID NO: 71016 - RNA, 27 nt, Artificial Sequence
  Vacuolar protein sorting-associated protein 16 homolog (139-147)
agccugcacgacaccgugacaacucuc

SEQ ID NO: 71017 - RNA, 27 nt, Artificial Sequence
  Probable phospholipid-transporting ATPase IH (690-698)
agccugcacgacgugcucuucgagcuu

SEQ ID NO: 71018 - RNA, 27 nt, Artificial Sequence
  Sarcoplasmic/endoplasmic reticulum calcium ATPase 1 (817-825)
agccugcacuuccucauccuuuacgug

SEQ ID NO: 71019 - RNA, 27 nt, Artificial Sequence
  Coatomer subunit alpha (27-35)
agccugcacaacggcgugauccagcuc

SEQ ID NO: 71020 - RNA, 27 nt, Artificial Sequence
  Forkhead box protein O1 (252-260)
agccugcacuccaaguucaucagagug

SEQ ID NO: 71021 - RNA, 36 nt, Artificial Sequence
  Serum albumin (89-100)
agccugcacacccucuucggcgacaagcuuugcaca

SEQ ID NO: 71022 - RNA, 27 nt, Artificial Sequence
  Adenosylhomocysteinase (198-206)
agccugaucgacggcauuaagagagcc

SEQ ID NO: 71023 - RNA, 27 nt, Artificial Sequence
  AP-1 complex subunit beta-1 (665-673)
agccugaucggcgggaccaacuucgug

SEQ ID NO: 71024 - RNA, 21 nt, Artificial Sequence
  Myoferlin (1042-1048)
agccugaucggcuggaaguuc

SEQ ID NO: 71025 - RNA, 27 nt, Artificial Sequence
  Protein LMBR1L (107-115)
agccugauccacggccucuggaaccuu

SEQ ID NO: 71026 - RNA, 27 nt, Artificial Sequence
  Abelson tyrosine-protein kinase 2 (153-161)
agccugaucaacggcuccuuccucgug

SEQ ID NO: 71027 - RNA, 33 nt, Artificial Sequence; identical to SEQ ID NO: 46800
  RNA-binding protein 34 (218-228)

SEQ ID NO: 71028 - RNA, 27 nt, Artificial Sequence
  DENN domain-containing protein 5B (1249-1257)
agccugaucagaauucuccagaccaua

SEQ ID NO: 71029 - RNA, 27 nt, Artificial Sequence
  Putative bifunctional UDP-N-acetylglucosamine transferase and deubiquitinase ALG13 (66-74)
agccugaaggaggacauccagaaagcc

SEQ ID NO: 71030 - RNA, 27 nt, Artificial Sequence
  Manganese-transporting ATPase 13A1 (594-602)
agccugaaguucgugggcuuuaucguc

SEQ ID NO: 71031 - RNA, 27 nt, Artificial Sequence
  Protocadherin gamma-C3 (402-410)
agccugaagaacuacuucacccucaaa

SEQ ID NO: 71032 - RNA, 27 nt, Artificial Sequence
  AP-3 complex delta subunit (882-890)
agccugcucgccgagaacuccuacgug

SEQ ID NO: 71033 - RNA, 30 nt, Artificial Sequence; identical to SEQ ID NO: 46806
  Exocyst complex component 1 (476-485)

SEQ ID NO: 71034 - RNA, 27 nt, Artificial Sequence
  Rotatin (1619-1627)
agccugcucgacaaccuucugaccauc

SEQ ID NO: 71035 - RNA, 36 nt, Artificial Sequence
  Eukaryotic translation initiation factor 3 subunit L (282-293)
agccugcucggcgacuacuaucaggccaucaaggug

SEQ ID NO: 71036 - RNA, 27 nt, Artificial Sequence
  Long-chain-fatty-acid-CoA ligase 3 (439-447)
agccugcucggcgggaacaucagacuu

SEQ ID NO: 71037 - RNA, 30 nt, Artificial Sequence
  Solute carrier family 22 member 18 (168-177)
agccugcucggcgggacccuuguguccgcc

SEQ ID NO: 71038 - RNA, 27 nt, Artificial Sequence
  Neurochondrin (337-345)
agccugcucaaggagccccagaaagug

SEQ ID NO: 71039 - RNA, 24 nt, Artificial Sequence
  Melanoma-associated antigen 10 (310-317)
agccugcucaaguuccuugccaaa

SEQ ID NO: 71040 - RNA, 27 nt, Artificial Sequence
  Melanoma-associated antigen 10 (310-318)
agccugcucaaguuccuugccaaagug

SEQ ID NO: 71041 - RNA, 27 nt, Artificial Sequence
  Zinc finger protein 644 (1297-1305)
agccugcucaagaaacccgccuccauc

SEQ ID NO: 71042 - RNA, 27 nt, Artificial Sequence
  Metallophosphoesterase 1 (21-29)
agccugcuccuuaagcugaucgccgug

SEQ ID NO: 71043 - RNA, 27 nt, Artificial Sequence
  Chromodomain-helicase-DNA-binding protein 4 (1004-1012)
agccugcucaacguggucauggaccuu

SEQ ID NO: 71044 - RNA, 27 nt, Artificial Sequence
  Importin-4 (220-228)
agccugcuccccuacuucccugccauc

SEQ ID NO: 71045 - RNA, 27 nt, Artificial Sequence
  G-protein coupled receptor 56 (5-13)
agccugcuccagaccacacuuuuccug

SEQ ID NO: 71046 - RNA, 27 nt, Artificial Sequence
  Pericentrin (2516-2524)
agccugcucuccgagauccaggcccuu

SEQ ID NO: 71047 - RNA, 27 nt, Artificial Sequence
  Bromodomain adjacent to zinc finger domain protein 2A (217-225)
agccugcucuccucuucagugcuuacc

SEQ ID NO: 71048 - RNA, 27 nt, Artificial Sequence
  Zinc finger ZZ-type and EF-hand domain-containing protein 1 (401-409)
agccugcucaccucccuugugacagcc

SEQ ID NO: 71049 - RNA, 36 nt, Artificial Sequence
  Delphilin (264-275)
agccugcucgugggcgggcuugccggacccgguggc

SEQ ID NO: 71050 - RNA, 27 nt, Artificial Sequence
  Band 4.1-like protein 2 (562-570)
agccugaugaaggacuuccccggcgcc

SEQ ID NO: 71051 - RNA, 24 nt, Artificial Sequence
  Oxysterol-binding protein-related protein 5 (301-308)
agccugauguggacccuccuuaag

SEQ ID NO: 71052 - RNA, 27 nt, Artificial Sequence
  EMILIN-1 (224-232)
agccugaacgagcuccagaccacagug

SEQ ID NO: 71053 - RNA, 27 nt, Artificial Sequence
  Glutamine and serine-rich protein 1 (920-928)
agccugaacggcaaucaggugaccguc

SEQ ID NO: 71054 - RNA, 27 nt, Artificial Sequence
  Neurofibromin (545-553)
agccugcccaaguucuaccuccuuuuu

SEQ ID NO: 71055 - RNA, 30 nt, Artificial Sequence
  Ras-related protein Rab-38 (113-122)
agccugcccaacggcaagccuguguccguc

SEQ ID NO: 71056 - RNA, 72 nt, Artificial Sequence
  Talin-1 (1227-1250)
agccugcccccuuccaccggcacauuccaggaggcccaaucuagacucaacgaagcugcagccgggcuuaau

SEQ ID NO: 71057 - RNA, 27 nt, Artificial Sequence
  Disabled homolog 2 (264-272)
agccugcccagaccuaccccacaggcc

SEQ ID NO: 71058 - RNA, 30 nt, Artificial Sequence
  P2X purinoceptor 7 (420-429)
agccugcaggacgugaagggccaagagguc

SEQ ID NO: 71059 - RNA, 27 nt, Artificial Sequence
  Unconventional myosin-Va (987-995)
agccugcaggaggaaaucgccaagcuc

SEQ ID NO: 71060 - RNA, 30 nt, Artificial Sequence
  Hyccin (485-494)
agccugcaggaggaaaagcucaucuacgug

SEQ ID NO: 71061 - RNA, 27 nt, Artificial Sequence
  A-kinase anchor protein 9 (576-584)
agccugcagaaggaccucucccaagug

SEQ ID NO: 71062 - RNA, 27 nt, Artificial Sequence
  Sulfate transporter (477-485)
agccugcagaaguccgugcucggcguc

SEQ ID NO: 71063 - RNA, 33 nt, Artificial Sequence
  Matrix metalloproteinase-14 (60-70)
agccuguccgccgcuaucgcagccaugcagaag

SEQ ID NO: 71064 - RNA, 27 nt, Artificial Sequence
  Ethanolamine kinase 2 (36-44)
agccuguccgccgacgugcccaagguc

SEQ ID NO: 71065 - RNA, 27 nt, Artificial Sequence
  Unconventional myosin-Ic (936-944)
agccuguccgacucucucuucgugcuu

SEQ ID NO: 71066 - RNA, 39 nt, Artificial Sequence
  Mucin-16 (10281-10293)
agccuguccgaggccaugaccucuuucgcuacaacuggc

SEQ ID NO: 71067 - RNA, 27 nt, Artificial Sequence
  CD109 antigen (1332-1340)
agccuguccgagaccgugaagaaaguc

SEQ ID NO: 71068 - RNA, 30 nt, Artificial Sequence; identical to SEQ ID NO: 46841
  Melanoma antigen preferentially expressed in tumors (355-364)

SEQ ID NO: 71069 - RNA, 27 nt, Artificial Sequence
  WD repeat-containing protein 1 (156-164)
agccuguccggcuacaucaacuaucuc

SEQ ID NO: 71070 - RNA, 27 nt, Artificial Sequence
  Protein phosphatase 1 regulatory subunit 21 (218-226)
agccuguccaucauuaacgagaaggug

SEQ ID NO: 71071 - RNA, 30 nt, Artificial Sequence
  DNA dC-dU-editing enzyme APOBEC-3B (446-455)
agccugucccccggccaccucccugugcca

SEQ ID NO: 71072 - RNA, 30 nt, Artificial Sequence
  Alpha-ketoglutarate-dependent dioxygenase alkB homolog 3 (81-90)
agccugucccccaccggcgugucuagaguc

SEQ ID NO: 71073 - RNA, 27 nt, Artificial Sequence
  E3 ubiquitin-protein ligase TRIM56 (586-594)
agccugucccaggccucucacgcugug

SEQ ID NO: 71074 - RNA, 27 nt, Artificial Sequence
  Coiled-coil domain-containing protein 91 (414-422)
agccuguccucucucgagcuuuuccug

SEQ ID NO: 71075 - RNA, 27 nt, Artificial Sequence
  Centrosomal protein of 290 kDa (11-19)
agccuguccucucuccuugugaagcug

SEQ ID NO: 71076 - RNA, 33 nt, Artificial Sequence
  Transcription factor HIVEP3 (1019-1029)
agccugaccggccccuccgccccugcuccagug

SEQ ID NO: 71077 - RNA, 27 nt, Artificial Sequence
  CDK5 regulatory subunit-associated protein 2 (1447-1455)
agccugaccuccgagauccacuuccuc

SEQ ID NO: 71078 - RNA, 27 nt, Artificial Sequence
  Epsilon-sarcoglycan (250-258)
agccugguggacaagaccaaacagguc

SEQ ID NO: 71079 - RNA, 33 nt, Artificial Sequence
  Transcription factor AP-2-epsilon (290-300)
agccugguggagggcgaagccguccaccucgcu

SEQ ID NO: 71080 - RNA, 27 nt, Artificial Sequence
  Tumor suppressor candidate 3 (209-217)
agccuggugggcgggcuccuuuaccug

SEQ ID NO: 71081 - RNA, 27 nt, Artificial Sequence
  U5 small nuclear ribonucleoprotein 200 kDa helicase (42-50)
agccuggugggcaagcucgaggggacc

SEQ ID NO: 71082 - RNA, 27 nt, Artificial Sequence
  Niban-like protein 1 (77-85)
agccuggugccccacaacuacggccuc

SEQ ID NO: 71083 - RNA, 21 nt, Artificial Sequence
  DNA mismatch repair protein Msh6 (342-348)
agccuggugcagaagggcuac

SEQ ID NO: 71084 - RNA, 27 nt, Artificial Sequence
  Piezo-type mechanosensitive ion channel component 1 (1709-1717)
agccuggugagauccgucguuggcgug

SEQ ID NO: 71085 - RNA, 30 nt, Artificial Sequence
  Arylsulfatase B (320-329)
agccugugggagggcggggugagaggaguc

SEQ ID NO: 71086 - RNA, 33 nt, Artificial Sequence
  Cohesin subunit SA-1 (487-497)
agccugugggaguccucucaggaacuccuuaag

SEQ ID NO: 71087 - RNA, 27 nt, Artificial Sequence
  Membrane magnesium transporter 1 (4-12)
agccuguggaagggccucguggggauc

SEQ ID NO: 71088 - RNA, 27 nt, Artificial Sequence
  Rho guanine nucleotide exchange factor 5 (1151-1159)
agccuguggcaggagauccccgugguc

SEQ ID NO: 71089 - RNA, 27 nt, Artificial Sequence
  Lysosomal-trafficking regulator (2437-2445)
agccuguacgacaacauccuccuucac

SEQ ID NO: 71090 - RNA, 33 nt, Artificial Sequence
  Lysosomal-trafficking regulator (2437-2447)
agccuguacgacaacauccuccuucacaaugcc

SEQ ID NO: 71091 - RNA, 27 nt, Artificial Sequence
  Chloride channel protein 2 (551-559)
agccuguacgacuccaucauuagaaua

SEQ ID NO: 71092 - RNA, 30 nt, Artificial Sequence; identical to SEQ ID NO: 46865
  WD repeat-containing protein 3 (586-595)

SEQ ID NO: 71093 - RNA, 27 nt, Artificial Sequence
  Protein YIPF4 (129-137)
agccuguacggccaguucagagugguc

SEQ ID NO: 71094 - RNA, 33 nt, Artificial Sequence
  Glutaminyl-peptide cyclotransferase (212-222)
agccuguacggcuccagacaccucgccgcuaag

SEQ ID NO: 71095 - RNA, 30 nt, Artificial Sequence
  Clathrin heavy chain 1 (1532-1541)
agccuguacaaggacgccaugcaguaugcu

SEQ ID NO: 71096 - RNA, 27 nt, Artificial Sequence
  Laminin subunit alpha-4 (855-863)
agccuguacaugaagcccccugugaaa

SEQ ID NO: 71097 - RNA, 27 nt, Artificial Sequence
  Membrane-associated transporter protein (382-390)
agccuguacuccuauuuccagaaggug

SEQ ID NO: 71098 - RNA, 27 nt, Artificial Sequence
  Cytoplasmic dynein 1 heavy chain 1 (3309-3317)
agcauggccaaccccccugcugcagug

SEQ ID NO: 71099 - RNA, 27 nt, Artificial Sequence
  Charged multivesicular body protein 2a (98-106)
agcauggcccaggcuaugaagggcgug

SEQ ID NO: 71100 - RNA, 27 nt, Artificial Sequence
  Probable ATP-dependent RNA helicase DDX59 (525-533)
agcauggacgaguacgugcaccagcug

SEQ ID NO: 71101 - RNA, 36 nt, Artificial Sequence
  Zinc finger protein 160 (58-69)
agcaugcuggaggaaggcaaggagcccuggaccgug

SEQ ID NO: 71102 - RNA, 30 nt, Artificial Sequence; identical to SEQ ID NO: 46875
  Serine palmitoyltransferase 3 (235-244)

SEQ ID NO: 71103 - RNA, 27 nt, Artificial Sequence
  Neuroblast differentiation-associated protein AHNAK (3672-3680)
agcaugcccgacuucgaucugaaccuc

SEQ ID NO: 71104 - RNA, 27 nt, Artificial Sequence
  Eukaryotic translation initiation factor 3 subunit L (303-311)
agcauguacuccagagugcccgagugc

SEQ ID NO: 71105 - RNA, 36 nt, Artificial Sequence
  Histone-lysine N-methyltransferase 2C (3371-3382)
agcaacgccaauccccaguccggcccuccaccgaga

SEQ ID NO: 71106 - RNA, 36 nt, Artificial Sequence
  ATP-dependent RNA helicase A (233-244)
agcaacaagaaacuggccgcucaguccugcgcacuc

SEQ ID NO: 71107 - RNA, 24 nt, Artificial Sequence
  Voltage-dependent L-type calcium channel subunit alpha-1C (157-164)
agcaaccuggagagaguggaauac

SEQ ID NO: 71108 - RNA, 24 nt, Artificial Sequence
  Aldehyde dehydrogenase, mitochondrial (130-137)
agcaaccugaagagagugacccuc

SEQ ID NO: 71109 - RNA, 27 nt, Artificial Sequence
  Protocadherin gamma-A12 (544-552)
agcaacgugucccugucucucuucguc

SEQ ID NO: 71110 - RNA, 27 nt, Artificial Sequence
  Neuropilin-2 (579-587)
agccccgccggcaucgggaugagacug

SEQ ID NO: 71111 - RNA, 27 nt, Artificial Sequence
  Sushi repeat-containing protein SRPX (3-11)
agccccgcccacagaccugcucugcuc

SEQ ID NO: 71112 - RNA, 30 nt, Artificial Sequence
  Sushi repeat-containing protein SRPX (3-12)
agccccgcccacagaccugcucugcuccuu

SEQ ID NO: 71113 - RNA, 24 nt, Artificial Sequence
  Staphylococcal nuclease domain-containing protein 1 (730-737)
agccccgccaagauccacguguuc

SEQ ID NO: 71114 - RNA, 27 nt, Artificial Sequence
  Plectin (1284-1292)
agccccgccaagaaaccuaaggugcag

SEQ ID NO: 71115 - RNA, 27 nt, Artificial Sequence
  Integrin beta-5 (81-89)
agccccgccuccucuuuccacgugcug

SEQ ID NO: 71116 - RNA, 27 nt, Artificial Sequence
  Nesprin-1 (72-80)
agccccgaggugggcagacugucccuc

SEQ ID NO: 71117 - RNA, 27 nt, Artificial Sequence
  Tetratricopeptide repeat protein 28 (1765-1773)
agccccuuccagaaggugggcaaacug

SEQ ID NO: 71118 - RNA, 36 nt, Artificial Sequence
  Carcinoembryonic antigen-related cell adhesion molecule 1 isoform 3 (361-372)
agccccggcgccaucgcugggauugugauaggaguc

SEQ ID NO: 71119 - RNA, 36 nt, Artificial Sequence
  Transport and Golgi organization protein 6 homolog (29-40)
agccccggcggguccggaucuucaagucugcaggug

SEQ ID NO: 71120 - RNA, 36 nt, Artificial Sequence
  Vimentin (56-67)
agccccggcgggguguacgccaccagauccucugcu

SEQ ID NO: 71121 - RNA, 27 nt, Artificial Sequence
  HEAT repeat-containing protein 5B (63-71)
agccccggcccuccaaccagaaagcug

SEQ ID NO: 71122 - RNA, 27 nt, Artificial Sequence
  Rho guanine nucleotide exchange factor 26 (304-312)
agccccggcucccugagaagggggcuc

SEQ ID NO: 71123 - RNA, 27 nt, Artificial Sequence
  Glia-derived nexin (66-74)
agcccccacggcaucgccuccgugcug

SEQ ID NO: 71124 - RNA, 30 nt, Artificial Sequence
  Tensin-3 (1123-1132)
agcccccacuccggcucuaccaucucaauu

SEQ ID NO: 71125 - RNA, 27 nt, Artificial Sequence
  Ankyrin repeat and BTB/POZ domain-containing protein 2 (632-640)
agccccaucccuuccauuccagagaua

SEQ ID NO: 71126 - RNA, 27 nt, Artificial Sequence
  F-box only protein 7 (406-414)
agccccaagggcagauucgugaugcug

SEQ ID NO: 71127 - RNA, 27 nt, Artificial Sequence
  Synaptic vesicle membrane protein VAT-1 homolog (249-257)
agccccaagggcguggacaucgucaug

SEQ ID NO: 71128 - RNA, 27 nt, Artificial Sequence
  Sodium-dependent neutral amino acid transporter B(0)AT2 (30-38)
agccccaagcugggcgggaucggauuc

SEQ ID NO: 71129 - RNA, 30 nt, Artificial Sequence; identical to SEQ ID NO: 46902
  Collagen alpha-1(XV) chain (314-323)

SEQ ID NO: 71130 - RNA, 27 nt, Artificial Sequence
  E3 ubiquitin-protein ligase RLIM (89-97)
agcccccugcacccuauguccgagauc

SEQ ID NO: 71131 - RNA, 30 nt, Artificial Sequence
  Cleavage stimulation factor subunit 2 (154-163)
agcccccaggaggccagaaacaugcugcuc

SEQ ID NO: 71132 - RNA, 27 nt, Artificial Sequence
  L-dopachrome tautomerase (134-142)
agcccccaggagagagaacaauuccug

SEQ ID NO: 71133 - RNA, 27 nt, Artificial Sequence
  Immunoglobulin superfamily member 11 (234-242)
agcccccagccuagaaacaucggccug

SEQ ID NO: 71134 - RNA, 27 nt, Artificial Sequence
  Collagen triple helix repeat-containing protein 1 (9-17)
agcccccagagacugaggggccuccuu

SEQ ID NO: 71135 - RNA, 27 nt, Artificial Sequence
  Ropporin-1A (153-161)
agccccagaaucccuuucuccaccuuu

SEQ ID NO: 71136 - RNA, 24 nt, Artificial Sequence
  Procollagen-lysine,2-oxoglutarate 5-dioxygenase 3 (702-709)
agccccagaaagggcugggcccug

SEQ ID NO: 71137 - RNA, 24 nt, Artificial Sequence
  Procollagen-lysine,2-oxoglutarate 5-dioxygenase 2 (174-181)
agccccagaaagggcugguccuuc

SEQ ID NO: 71138 - RNA, 24 nt, Artificial Sequence
  Delta-like protein 3 (3-10)
agccccagaauguccggccugcuc

SEQ ID NO: 71139 - RNA, 33 nt, Artificial Sequence
  Delta-like protein 3 (3-13)
agccccagaauguccggccugcucucucagacc

SEQ ID NO: 71140 - RNA, 27 nt, Artificial Sequence
  Integrin alpha-7 (803-811)
agccccagaccuaacauccugcaccuc

SEQ ID NO: 71141 - RNA, 27 nt, Artificial Sequence
  Protocadherin gamma-C3 (65-73)
agccccagacagacccugacagugcuc

SEQ ID NO: 71142 - RNA, 27 nt, Artificial Sequence
  RPA-interacting protein (7-15)
agccccagaaggucccuguacaagcuc

SEQ ID NO: 71143 - RNA, 27 nt, Artificial Sequence
  E3 ubiquitin-protein ligase RING1 (9-17)
agccccagaucccugcacucugagcuc

SEQ ID NO: 71144 - RNA, 27 nt, Artificial Sequence
  AP-1 complex subunit sigma-1A (146-154)
agccccagauccgugcuggaggaaaug

SEQ ID NO: 71145 - RNA, 54 nt, Artificial Sequence
  Fatty acid synthase (856-873)
agccccuccgccgcuaucuacaacauugacaccucuucagagaguccugaucac

SEQ ID NO: 71146 - RNA, 27 nt, Artificial Sequence
  Rho GTPase-activating protein 32 (243-251)
agccccuccaccaagcugcucacacuu

SEQ ID NO: 71147 - RNA, 30 nt, Artificial Sequence
  Melanoma antigen preferentially expressed in tumors (345-354)
agccccuccgugucucagcugucaguccuc

SEQ ID NO: 71148 - RNA, 27 nt, Artificial Sequence
  SAM and SH3 domain-containing protein 1 (442-450)
agccccaccgccuccagaaucucucug

SEQ ID NO: 71149 - RNA, 27 nt, Artificial Sequence
  Transcription factor Dp-2 (24-32)
agccccaccaagggcaacaucuccuuc

SEQ ID NO: 71150 - RNA, 27 nt, Artificial Sequence
  Bestrophin-1 (499-507)
agccccaccaacauccacacaacucug

SEQ ID NO: 71151 - RNA, 27 nt, Artificial Sequence
  Nuclear factor 1 X-type (373-381)
agccccuacuucacccacccuacaauc

SEQ ID NO: 71152 - RNA, 27 nt, Artificial Sequence
  Zinc finger CCHC domain-containing protein 24 (93-101)
agccccuacggcucccugaacaauauc

SEQ ID NO: 71153 - RNA, 27 nt, Artificial Sequence
  Zinc finger protein 503 (341-349)
agccccuacaagccuggccagaccgug

SEQ ID NO: 71154 - RNA, 30 nt, Artificial Sequence
  Retinoic acid receptor RXR-gamma (68-77)
agccccuacagagugaucaccuccgccaug

SEQ ID NO: 71155 - RNA, 24 nt, Artificial Sequence
  Filamin-A (1603-1610)
agccccuacagagugagggccguc

SEQ ID NO: 71156 - RNA, 63 nt, Artificial Sequence
  HLA class I histocompatibility antigen, A-23 alpha chain (345-365)
agccaggccgcuuccucugacucagcacaaggcagugaugugagccugaccgccugcaagguc

SEQ ID NO: 71157 - RNA, 72 nt, Artificial Sequence
  AT-rich interactive domain-containing protein 1A (334-357)
agccagugcuggggcgccgcugcagccgcggcugccgcagccgcugcauccgggggagcccaacagagaucu

SEQ ID NO: 71158 - RNA, 24 nt, Artificial Sequence
  Hemicentin-1 (1082-1089)
agccaggacaagcccguggagauc

SEQ ID NO: 71159 - RNA, 27 nt, Artificial Sequence
  Very large A-kinase anchor protein (777-785)
agccaggaccccaacagaguggagcug

SEQ ID NO: 71160 - RNA, 27 nt, Artificial Sequence
  Transmembrane protein 131 (324-332)
agccaguucuccggcaagaucaccgug

SEQ ID NO: 71161 - RNA, 63 nt, Artificial Sequence
  Hsp70-binding protein 1 (65-85)
agccagggcugcuccucugggggagguggcgggggaucaagugccggcgguagcgggaacucc

SEQ ID NO: 71162 - RNA, 30 nt, Artificial Sequence
  Histone acetyltransferase p300 (1897-1906)
agccagggcaaggccgcugggcaagugacc

SEQ ID NO: 71163 - RNA, 36 nt, Artificial Sequence
  Beta-2-microglobulin (87-98)
agccagcccaagaucgugaaaugggacagagauaug

SEQ ID NO: 71164 - RNA, 39 nt, Artificial Sequence
  Ras-associating and dilute domain-containing protein (258-270)
agccagcaacacgacucccugguguacguccucaacaga

SEQ ID NO: 71165 - RNA, 30 nt, Artificial Sequence
  Oxysterol-binding protein-related protein 10 (232-241)
agccaguacuccggccaacugcacgaggug

SEQ ID NO: 71166 - RNA, 27 nt, Artificial Sequence
  Transmembrane and TPR repeat-containing protein 2 (541-549)
agcagauucgccgaggcucugcacuac

SEQ ID NO: 71167 - RNA, 27 nt, Artificial Sequence
  Pre-mRNA-processing-splicing factor 8 (979-987)
agcagauucgagaagauguacgaaaaa

SEQ ID NO: 71168 - RNA, 27 nt, Artificial Sequence
  Glia-derived nexin (207-215)
agcagauuccagcccgagaacaccaag

SEQ ID NO: 71169 - RNA, 18 nt, Artificial Sequence
  ER membrane protein complex subunit 1 (7-12)
agcagauucuggcugugg

SEQ ID NO: 71170 - RNA, 24 nt, Artificial Sequence
  Splicing factor 3B subunit 3 (33-40)
agcagaggcaagauccuggagcuc

SEQ ID NO: 71171 - RNA, 27 nt, Artificial Sequence
  Maltase-glucoamylase (658-666)
agcagacacuaccugaacaucagguau

SEQ ID NO: 71172 - RNA, 27 nt, Artificial Sequence
  B-cell lymphoma 6 protein (444-452)
agcagacugaacaauaucgugaacagg

SEQ ID NO: 71173 - RNA, 27 nt, Artificial Sequence
  Centrosomal protein C10orf90 (199-207)
agcagaaacuccucuguggucaggcug

SEQ ID NO: 71174 - RNA, 27 nt, Artificial Sequence
  Maltase-glucoamylase, intestinal (1482-1490)
agcagaaacgugcugcagaccagguac

SEQ ID NO: 71175 - RNA, 66 nt, Artificial Sequence
  Glia-derived nexin (57-78)
agcagaccccacgacaacaucgugauuuccccucauggcauagccucuguccuggggaugcuccag

SEQ ID NO: 71176 - RNA, 24 nt, Artificial Sequence
  Arylsulfatase B (42-49)
agcagacccccucaccugguguuc

SEQ ID NO: 71177 - RNA, 27 nt, Artificial Sequence
  Fatty acid synthase (1916-1924)
agcagauccggcaucaggaccggguac

SEQ ID NO: 71178 - RNA, 27 nt, Artificial Sequence
  Vasorin (3-11)
agcagagugccccugcuccuuccucug

SEQ ID NO: 71179 - RNA, 24 nt, Artificial Sequence
  Semaphorin-3A (543-550)
agcagauacuuccccaccgccaag

SEQ ID NO: 71180 - RNA, 48 nt, Artificial Sequence
  Alpha-1D adrenergic receptor (23-38)
agcuccgccggcgggggagguggcucugcugggggagcagcccccuca

SEQ ID NO: 71181 - RNA, 27 nt, Artificial Sequence
  Insulin receptor substrate 2 (311-319)
agcuccgccacccaccccaucucugug

SEQ ID NO: 71182 - RNA, 27 nt, Artificial Sequence
  Protein CMSS1 (145-153)
agcuccgccgugagagcucuggagcuc

SEQ ID NO: 71183 - RNA, 27 nt, Artificial Sequence
  Protein FAM127A (59-67)
agcuccgacgcccugaaggugaccuuc

SEQ ID NO: 71184 - RNA, 30 nt, Artificial Sequence
  Beta-1-syntrophin (489-498)
agcuccgacgauggcaucagaaugcuguac

SEQ ID NO: 71185 - RNA, 27 nt, Artificial Sequence
  Transcription elongation factor B polypeptide 1 (7-15)
agcuccgacggccacgaguucaucgug

SEQ ID NO: 71186 - RNA, 27 nt, Artificial Sequence
  Cyclin-dependent kinase-like 3 (88-96)
agcuccgaccugcuccaccaugaguac

SEQ ID NO: 71187 - RNA, 27 nt, Artificial Sequence
  Neutrophil collagenase (228-236)
agcuccgaccccggcgcccugauguac

SEQ ID NO: 71188 - RNA, 51 nt, Artificial Sequence
  HLA class I histocompatibility antigen, A-23 alpha chain (349-365)
agcuccgacucugcccagggcucagaugugagucugaccgcuugcaagguc

SEQ ID NO: 71189 - RNA, 84 nt, Artificial Sequence
  NADH dehydrogenase (ubiquinone) 1 beta subcomplex subunit 11, mitochondrial (31-58)
agcuccuucucuagaaccguggucgcccccucagcuguugcaggcaagaggccuccagagccgacaacucccuggcaggaagac

SEQ ID NO: 71190 - RNA, 39 nt, Artificial Sequence
  Keratin, type I cytoskeletal 10 (570-582)
agcuccggcucugugggggagucaaguagcaagggaccc

SEQ ID NO: 71191 - RNA, 21 nt, Artificial Sequence
  Zinc finger protein 697 (329-335)
agcucccaccugcucucucau

SEQ ID NO: 71192 - RNA, 21 nt, Artificial Sequence
  BTB/POZ domain-containing protein KCTD20 (144-150)
agcuccaagcuguacagauuc

SEQ ID NO: 71193 - RNA, 39 nt, Artificial Sequence
  Voltage-dependent anion-selective channel protein 1 (240-252)
agcucccugaucggccucggguacacccagacacuuaag

SEQ ID NO: 71194 - RNA, 27 nt, Artificial Sequence
  Phosphatidylinositol 4-phosphate 3-kinase C2 domain-containing subunit alpha (1113-1121)
agcuccaacgccgugccccugaagguc

SEQ ID NO: 71195 - RNA, 27 nt, Artificial Sequence
  Niemann-Pick C1 protein (167-175)
agcuccaacgacaaggcccugggccuc

SEQ ID NO: 71196 - RNA, 27 nt, Artificial Sequence
  Ligand of Numb protein X 2 (382-390)
agcuccaacgacagagugcuggccauc

SEQ ID NO: 71197 - RNA, 42 nt, Artificial Sequence
  Beta-secretase 2 (113-126)
agcuccaacuucgccguggcuggcaccccccacucuuacauc

SEQ ID NO: 71198 - RNA, 45 nt, Artificial Sequence
  Beta-secretase 2 (113-127)
agcuccaacuucgccguggcuggcaccccccacucuuacaucgac

SEQ ID NO: 71199 - RNA, 48 nt, Artificial Sequence
  Beta-secretase 2 (113-128)
agcuccaacuucgccguggcuggcaccccccacucuuacaucgacaca

SEQ ID NO: 71200 - RNA, 27 nt, Artificial Sequence
  Alpha-taxilin (438-446)
agcuccaacaaggcccugcucgagaug

SEQ ID NO: 71201 - RNA, 27 nt, Artificial Sequence
  Plakophilin-4 (457-465)
agcucccagagaucuacccugacauac

SEQ ID NO: 71202 - RNA, 27 nt, Artificial Sequence
  Golgin subfamily B member 1 (3000-3008)
agcucccagacccaaccccugaaggug

SEQ ID NO: 71203 - RNA, 33 nt, Artificial Sequence
  Transducin-like enhancer protein 3 (167-177)
agcuccucuggccugcucgcccuuggggcucug

SEQ ID NO: 71204 - RNA, 42 nt, Artificial Sequence
  Keratin, type I cytoskeletal 10 (37-50)
agcuccucuaagggcucacuggggggagguuucaguagcggc

SEQ ID NO: 71205 - RNA, 45 nt, Artificial Sequence
  Keratin, type I cytoskeletal 10 (37-51)
agcuccucuaagggcucacuggggggagguuucaguagcggcggg

SEQ ID NO: 71206 - RNA, 48 nt, Artificial Sequence
  Keratin, type I cytoskeletal 10 (37-52)
agcuccucuaagggcucacuggggggagguuucaguagcggcggguuu

SEQ ID NO: 71207 - RNA, 54 nt, Artificial Sequence
  Keratin, type I cytoskeletal 10 (37-54)
agcuccucuaagggcucacuggggggagguuucaguagcggcggguuuuccgga

SEQ ID NO: 71208 - RNA, 57 nt, Artificial Sequence
  Keratin, type I cytoskeletal 10 (37-55)
agcuccucuaagggcucacuggggggagguuucaguagcggcggguuuuccggaggc

SEQ ID NO: 71209 - RNA, 27 nt, Artificial Sequence
  Actin, gamma-enteric smooth muscle (190-198)
agcuccucuucacuggagaagaguuac

SEQ ID NO: 71210 - RNA, 39 nt, Artificial Sequence
  Synaptotagmin-like protein 2 (277-289)
agcuccucuucaaguaccgacagcgagacacugagauac

SEQ ID NO: 71211 - RNA, 36 nt, Artificial Sequence
  Synaptotagmin-like protein 2 (279-290)
agcuccucuucaaccgacagugagacacugagauac

SEQ ID NO: 71212 - RNA, 30 nt, Artificial Sequence
  Synaptotagmin-like protein 2 (281-290)
agcuccaccgacucugagacacugagauac

SEQ ID NO: 71213 - RNA, 27 nt, Artificial Sequence
  F-actin-capping protein subunit beta (41-49)
agcuccguggaccagccccugaagauc

SEQ ID NO: 71214 - RNA, 21 nt, Artificial Sequence
  TATA-binding protein-associated factor 2N (44-50)
agcuccuacggccagaacuau

SEQ ID NO: 71215 - RNA, 27 nt, Artificial Sequence
  Poly(rC)-binding protein 4 (68-76)
agcaccgccgcuguguuccacgcaguc

SEQ ID NO: 71216 - RNA, 24 nt, Artificial Sequence
  40S ribosomal protein S19 (59-66)
agcaccgccagacaccuguaccuc

SEQ ID NO: 71217 - RNA, 33 nt, Artificial Sequence
  Regulator of G-protein signaling 12 (284-294)
agcaccgacaaggccggcguggucgcugaguac

SEQ ID NO: 71218 - RNA, 30 nt, Artificial Sequence
  Neuropilin-2 (829-838)
agcaccgacaaggagaaauccuggcuguac

SEQ ID NO: 71219 - RNA, 30 nt, Artificial Sequence
  Protein LZIC (168-177)
agcaccgaccugggcagacccccuuccuac

SEQ ID NO: 71220 - RNA, 27 nt, Artificial Sequence
  Transcription factor HES-1 (101-109)
agcaccgaccccuccgugcugggcaag

SEQ ID NO: 71221 - RNA, 24 nt, Artificial Sequence
  Heterogeneous nuclear ribonucleoprotein K (188-195)
agcaccgacagagugguccugauc

SEQ ID NO: 71222 - RNA, 30 nt, Artificial Sequence
  CUB and sushi domain-containing protein 1 (1359-1368)
agcaccuucaacucccugacacuccaguuu

SEQ ID NO: 71223 - RNA, 24 nt, Artificial Sequence
  Transcription termination factor 2 (827-834)
agcaccggcagaccccuggugauc

SEQ ID NO: 71224 - RNA, 24 nt, Artificial Sequence
  Basic leucine zipper and W2 domain-containing protein 2 (54-61)
agcaccggcuccagacuggacuac

SEQ ID NO: 71225 - RNA, 21 nt, Artificial Sequence
  Synemin (859-865)
agcaccaucagauacuccugg

SEQ ID NO: 71226 - RNA, 54 nt, Artificial Sequence
  Transformation/transcription domain-associated protein (377-394)
agcacccuggccgaccucgugcaccaugucagacagcaccuuccccuguccgau

SEQ ID NO: 71227 - RNA, 21 nt, Artificial Sequence
  Nicalin (264-270)
agcacccuggagcaccaucuc

SEQ ID NO: 71228 - RNA, 93 nt, Artificial Sequence
  CXXC-type zinc finger protein 5 (18-48)
agcaccaacggcuccgggggaucugguucaaguggccccaaggccggggcugcagacaaaagcgccguggucgcggcugccgcaccugccucc

SEQ ID NO: 71229 - RNA, 30 nt, Artificial Sequence
  Transmembraneoprotein NMB (294-303)
agcaccaaccacacagugaaucauacuuac

SEQ ID NO: 71230 - RNA, 27 nt, Artificial Sequence
  Patatin-like phospholipase domain-containing protein 2 (199-207)
agcaccaacauccacgagcugagagug

SEQ ID NO: 71231 - RNA, 27 nt, Artificial Sequence
  Sodium/potassium-transporting ATPase subunit alpha-3 (487-495)
agcaccaacaaguaccagcuguccauc

SEQ ID NO: 71232 - RNA, 27 nt, Artificial Sequence
  Transmembrane emp24 domain-containing protein 10 (181-189)
agcaccaacacaagagugcuguacuuc

SEQ ID NO: 71233 - RNA, 27 nt, Artificial Sequence
  DNA-directed RNA polymerase I subunit RPA2 (156-164)
agcacccagaagcaagugcugaacuac

SEQ ID NO: 71234 - RNA, 24 nt, Artificial Sequence
  Protein-methionine sulfoxide oxidase MICAL3 (646-653)
agcaccagaucccccaucucuuuc

SEQ ID NO: 71235 - RNA, 45 nt, Artificial Sequence
  Vimentin (2-16)
agcaccagauccgugucuucaaguagcuacaggcggauguucggc

SEQ ID NO: 71236 - RNA, 45 nt, Artificial Sequence
  Vimentin (47-61)
agcaccuccagaucucuguacgccucaagucccggcgggguguau

SEQ ID NO: 71237 - RNA, 21 nt, Artificial Sequence
  WD repeat-containing protein 36 (352-358)
agcaccgugcacgagaaguuc

SEQ ID NO: 71238 - RNA, 27 nt, Artificial Sequence
  Zinc finger CCHC domain-containing protein 3 (228-236)
agcguggccgcucagcugaccggcguc

SEQ ID NO: 71239 - RNA, 27 nt, Artificial Sequence
  Zinc finger protein 518B (424-432)
agcguggcccugaagggccacucccuc

SEQ ID NO: 71240 - RNA, 33 nt, Artificial Sequence
  Latent-transforming growth factor beta-binding protein 3 (178-188)
agcguggccuccaagcacgcuaucuacgcaguc

SEQ ID NO: 71241 - RNA, 27 nt, Artificial Sequence
  3-hydroxybutyrate dehydrogenase type 2 (133-141)
agcguggccuccucugucaagggcguu

SEQ ID NO: 71242 - RNA, 60 nt, Artificial Sequence
  Chondroitin sulfate proteoglycan 4 (124-143)
agcguggacggcuuccugaacgccuccucugcuguccccggggcaccucucgagguucca

SEQ ID NO: 71243 - RNA, 27 nt, Artificial Sequence
  GDNF-inducible zinc finger protein 1 (69-77)
agcguggacggcaccagaacaaacguc

SEQ ID NO: 71244 - RNA, 27 nt, Artificial Sequence
  Protein AHNAK2 (2175-2183)
agcguggacgucucccccccuaagguu

SEQ ID NO: 71245 - RNA, 27 nt, Artificial Sequence
  Phospholipase B-like 1 (304-312)
agcguguucaacaagacccugcucaaa

SEQ ID NO: 71246 - RNA, 21 nt, Artificial Sequence
  Clathrin interactor 1 (166-172)
agcgugggcggguucagauac

SEQ ID NO: 71247 - RNA, 57 nt, Artificial Sequence
  Prelamin-A/C (479-497)
agcgugggcggguccggagguggcucuuucggggacaaccuggucaccagaucauac

SEQ ID NO: 71248 - RNA, 27 nt, Artificial Sequence
  Heterogeneous nuclear ribonucleoprotein C-like 1 (47-55)
agcgugcacaagggcuucgccuuuguc

SEQ ID NO: 71249 - RNA, 27 nt, Artificial Sequence
  COUP transcription factor 2 (223-231)
agcgugaucgagcagcuguucuuuguc

SEQ ID NO: 71250 - RNA, 27 nt, Artificial Sequence
  Serine/threonine-protein kinase ICK (533-541)
agcgugaucuccaaggucaacucuguu

SEQ ID NO: 71251 - RNA, 69 nt, Artificial Sequence
  Glutathione reductase, mitochondrial (234-256)
agcgugaucgucggcgccggguacauugcuguugagauggcaggaauacuguccgcccucgguucuaag

SEQ ID NO: 71252 - RNA, 27 nt, Artificial Sequence
  Kelch-like protein 21 (378-386)
agcgugcuggacggccuccuuuacguc

SEQ ID NO: 71253 - RNA, 30 nt, Artificial Sequence
  Protein transport protein Sec61 subunit alpha isoform 1 (353-362)
agcgugcuggaggaccccguccacgccguu

SEQ ID NO: 71254 - RNA, 21 nt, Artificial Sequence
  Tetratricopeptide repeat protein 27 (74-80)
agcgugcuguuccagcaauuu

SEQ ID NO: 71255 - RNA, 27 nt, Artificial Sequence
  Histone-lysine N-methyltransferase SETD1B (168-176)
agcgugaugggcaacaucauucacguc

SEQ ID NO: 71256 - RNA, 27 nt, Artificial Sequence
  E3 ubiquitin-protein ligase UBR4 (884-892)
agcgugaacagauacauccugcagcuc

SEQ ID NO: 71257 - RNA, 36 nt, Artificial Sequence
  Integral membrane protein GPR137C (4-15)
agcgugcccggcccugccgcugcagccgcgccagcu

SEQ ID NO: 71258 - RNA, 78 nt, Artificial Sequence
  CCR4-NOT transcription complex subunit 3 (392-417)
agcgugcagcccuccggcgggggagguggcgggucuggaggcggugggucaaguagcuccucuaacucgucagccgga

SEQ ID NO: 71259 - RNA, 30 nt, Artificial Sequence
  Transmembrane protein 98 (124-133)
agcguguccgacaucauugucguugccaag

SEQ ID NO: 71260 - RNA, 27 nt, Artificial Sequence
  Adipocyte enhancer-binding protein 1 (926-934)
agcguguccggcaucaaccacgggguc

SEQ ID NO: 71261 - RNA, 27 nt, Artificial Sequence
  Dimethyladenosine transferase 1, mitochondrial (145-153)
agcguguccaccccccugaucauuaag

SEQ ID NO: 71262 - RNA, 27 nt, Artificial Sequence
  Dolichyl-diphosphooligosaccharide-proteinosyltransferase subunit 2 (121-129)
agcgugacccagaucuaccacgccguc

SEQ ID NO: 71263 - RNA, 27 nt, Artificial Sequence
  Lysine-specific demethylase 4B (1000-1008)
agcgugaccucccacaucuaccagguc

SEQ ID NO: 71264 - RNA, 27 nt, Artificial Sequence
  PR domain zinc finger protein 2 (684-692)
agcguguaccuguccucuaagcucaaa

SEQ ID NO: 71265 - RNA, 24 nt, Artificial Sequence
  Suppressor of tumorigenicity 7 protein (439-446)
agcguguaccccaagaaagagcug

SEQ ID NO: 71266 - RNA, 36 nt, Artificial Sequence
  Semaphorin-3D (430-441)
agcguguaccccgucgccggcgggccuaccuucaag

SEQ ID NO: 71267 - RNA, 30 nt, Artificial Sequence
  Melanophilin (449-458)
agcguguacagaggcucccugacccagagg

SEQ ID NO: 71268 - RNA, 30 nt, Artificial Sequence
  Cathepsin B (254-263)
agcguguacuccgacuuccugcucuauaag

SEQ ID NO: 71269 - RNA, 36 nt, Artificial Sequence; identical to SEQ ID NO: 47042
  Synaptotagmin-like protein 2 (618-629)

SEQ ID NO: 71270 - RNA, 27 nt, Artificial Sequence
  Retrotransposon gag domain-containing protein 4 (253-261)
agcuacgccgacgcuuuccaguuucug

SEQ ID NO: 71271 - RNA, 27 nt, Artificial Sequence
  WD repeat-containing protein 11 (156-164)
agcuacgccgacaacauccuguccuuc

SEQ ID NO: 71272 - RNA, 27 nt, Artificial Sequence
  SH3 domain-binding protein 1 (158-166)
agcuacgccaacuauuucaucagacug

SEQ ID NO: 71273 - RNA, 60 nt, Artificial Sequence
  Thioredoxin reductase 1, cytoplasmic (10-29)
agcuacgacuaugaucugaucauuauaggcgggggauccgguggccucgccgcugcaaag

SEQ ID NO: 71274 - RNA, 27 nt, Artificial Sequence
  Dedicator of cytokinesis protein 7 (739-747)
agcuacauccacuauguguucagacug

SEQ ID NO: 71275 - RNA, 27 nt, Artificial Sequence
  Transportin-2 (516-524)
agcuacauccuggacacccucguguuc

SEQ ID NO: 71276 - RNA, 27 nt, Artificial Sequence
  E3 ubiquitin-protein ligase TRIM58 (431-439)
agcuacaucuauaccuucaaccagcug

SEQ ID NO: 71277 - RNA, 27 nt, Artificial Sequence
  SMC5-SMC6 complex localization factor protein 2 (901-909)
agcuacaagcccaucuucuccacccug

SEQ ID NO: 71278 - RNA, 21 nt, Artificial Sequence
  Nicotinamide phosphoribosyltransferase (17-23)
agcuacaaggugacccacuau

SEQ ID NO: 71279 - RNA, 27 nt, Artificial Sequence
  Zinc finger CCHC domain-containing protein 24 (70-78)
agcuaccugaacuccuucuuucagcuc

SEQ ID NO: 71280 - RNA, 27 nt, Artificial Sequence
  Glycogenin-1 (194-202)
agcuaccugcccgccuucaagguguuu

SEQ ID NO: 71281 - RNA, 27 nt, Artificial Sequence
  DNA-directed RNA polymerase III subunit RPC2 (532-540)
agcuaccccaacguguuccuggucuuu

SEQ ID NO: 71282 - RNA, 27 nt, Artificial Sequence
  Helicase-like transcription factor (29-37)
agcuaccccaccuucuuuccuagauuc

SEQ ID NO: 71283 - RNA, 27 nt, Artificial Sequence
  Nesprin-1 (3393-3401)
agcuaccaggacggcgugagacaauuc

SEQ ID NO: 71284 - RNA, 27 nt, Artificial Sequence
  RB1-inducible coiled-coil protein 1 (163-171)
agcuaccagaagcugcucuucaaauuu

SEQ ID NO: 71285 - RNA, 27 nt, Artificial Sequence
  Farnesyl pyrophosphate synthase (314-322)
agcuacucccacaucauggcccugauu

SEQ ID NO: 71286 - RNA, 24 nt, Artificial Sequence
  2',3'-cyclic-nucleotide 3'-phosphodiesterase (257-264)
agcuacuccaaggccuucacccug

SEQ ID NO: 71287 - RNA, 69 nt, Artificial Sequence
  HLA class I histocompatibility antigen, A-23 alpha chain (343-365)
agcuacucccaggccgcuucuucagacagugcacaaggcagcgaugugucccugaccgccugcaagguc

SEQ ID NO: 71288 - RNA, 69 nt, Artificial Sequence
  HLA class I histocompatibility antigen, A-1 alpha chain (318-340)
agcuacacccaggccgcuuccucugacucagcacaaggcagugaugugagccugacagccugcaagguc

SEQ ID NO: 71289 - RNA, 27 nt, Artificial Sequence
  Mediator of RNA polymerase II transcription subunit 13-like (933-941)
agcuacgugcacaagguccccuccuuc

SEQ ID NO: 71290 - RNA, 18 nt, Artificial Sequence
  Amyloid protein-binding protein 2 (340-345)
agcuacgugcaccaguau

SEQ ID NO: 71291 - RNA, 27 nt, Artificial Sequence
  Melanoma-associated antigen 12 (282-290)
agcuacgugaagguccugcaccaucuc

SEQ ID NO: 71292 - RNA, 27 nt, Artificial Sequence
  Dolichyl-diphosphooligosaccharide-proteinosyltransferase 48 kDa subunit (22-30)
accgccgcuagagcaugggcccuguuc

SEQ ID NO: 71293 - RNA, 27 nt, Artificial Sequence
  Protein AATF (30-38)
accgccgcuagagugaucgacagguuc

SEQ ID NO: 71294 - RNA, 30 nt, Artificial Sequence
  Dolichyl-diphosphooligosaccharide-proteinosyltransferase 48 kDa subunit (78-87)
accgccgacgaucccagccugucccucauc

SEQ ID NO: 71295 - RNA, 24 nt, Artificial Sequence
  Triokinase/FMN cyclase (233-240)
accgccgacgagaucgugaagcug

SEQ ID NO: 71296 - RNA, 27 nt, Artificial Sequence
  Calcium homeostasis endoplasmic reticulum protein (170-178)
accgccgacggcgcucacuucgagcug

SEQ ID NO: 71297 - RNA, 27 nt, Artificial Sequence
  Transducin beta-like protein 3 (197-205)
accgccgaccacaaccugcuccuuuac

SEQ ID NO: 71298 - RNA, 27 nt, Artificial Sequence
  Late secretory pathway protein AVL9 homolog (340-348)
accgccgacgugagccacacaaaccug

SEQ ID NO: 71299 - RNA, 30 nt, Artificial Sequence; identical to SEQ ID NO: 47072
  Histone acetyltransferase type B catalytic subunit (274-283)

SEQ ID NO: 71300 - RNA, 63 nt, Artificial Sequence
  3-hydroxyacyl-CoA dehydrogenase type-2 (26-46)
accgccgagagacuggugggccagggggcuagcgcaguccuccuugaccugcccaacuccgga

SEQ ID NO: 71301 - RNA, 24 nt, Artificial Sequence
  H(+)/Cl(-) exchange transporter 7 (101-108)
accgccuucagaacaguggagauc

SEQ ID NO: 71302 - RNA, 84 nt, Artificial Sequence
  Alpha-1,6-mannosylglycoprotein 6-beta-N-acetylglucosaminyltransferase A (288-315)
accgccuucagcggcgggccccugggagagcucgugcagugguccgaccuuaucacaucucuguacuuguuaggucacgauauu

SEQ ID NO: 71303 - RNA, 24 nt, Artificial Sequence
  Cleavage and polyadenylation specificity factor subunit 2 (239-246)
accgccggcagagugcuggagcuc

SEQ ID NO: 71304 - RNA, 27 nt, Artificial Sequence
  Biorientation of chromosomes in cell division protein 1-like 1 (1268-1276)
accgccaaggaccccagcguguccauc

SEQ ID NO: 71305 - RNA, 24 nt, Artificial Sequence
  Guanine nucleotide exchange factor for Rab-3A (87-94)
accgcccugaagacacucgugauc

SEQ ID NO: 71306 - RNA, 75 nt, Artificial Sequence
  60 kDa heat shock protein, mitochondrial (527-551)
accgcccugcucgacgcugcaggcguggccagccuucugacaacugcggaggucguugugacggaaauccccaag

SEQ ID NO: 71307 - RNA, 84 nt, Artificial Sequence
  60 kDa heat shock protein, mitochondrial (527-554)
accgcccugcucgacgcugcaggcguggccagccuucugacaacugcggaggucguugugacggaaauccccaaggaggaaaaa

SEQ ID NO: 71308 - RNA, 42 nt, Artificial Sequence
  Plexin-B2 (1522-1535)
accgcccagauccugagcgaccucgaucuuacaucccaaaga

SEQ ID NO: 71309 - RNA, 21 nt, Artificial Sequence
  40S ribosomal protein S19 (60-66)
accgccagacaccuguaccuc

SEQ ID NO: 71310 - RNA, 48 nt, Artificial Sequence
  Zinc finger SWIM domain-containing protein 8 (1087-1102)
accgccagccagagaucccccucuaagcacggcgggccuucagcucca

SEQ ID NO: 71311 - RNA, 51 nt, Artificial Sequence
  Eukaryotic initiation factor 4A-I (83-99)
accgccacauucgcuaucagcauucugcagcaaauagagcucgaccuuaag

SEQ ID NO: 71312 - RNA, 42 nt, Artificial Sequence
  Tubulin alpha-1C chain (249-262)
accgccguggucgagcccuacaacagcauccugacaacucac

SEQ ID NO: 71313 - RNA, 30 nt, Artificial Sequence
  Endoplasmin (419-428)
accgacgauuuccacgacaugaugcccaag

SEQ ID NO: 71314 - RNA, 24 nt, Artificial Sequence
  GPI transamidase component PIG-T (162-169)
accgaccacuacuuccugagauau

SEQ ID NO: 71315 - RNA, 42 nt, Artificial Sequence
  Alpha-enolase (67-80)
accgacaagguggucaucggcauggauguugccgcuagcgag

SEQ ID NO: 71316 - RNA, 48 nt, Artificial Sequence
  Alpha-enolase (67-82)
accgacaagguggucaucggcauggauguugccgcuagcgaguucuuu

SEQ ID NO: 71317 - RNA, 42 nt, Artificial Sequence
  4F2 cell-surface antigen heavy chain (174-187)
accgaccugcuccagaucgaucccaacuucggcagcaaggag

SEQ ID NO: 71318 - RNA, 45 nt, Artificial Sequence
  4F2 cell-surface antigen heavy chain (174-188)
accgaccugcuccagaucgaucccaacuucggcagcaaggaggac

SEQ ID NO: 71319 - RNA, 24 nt, Artificial Sequence
  Synaptotagmin-like protein 2 (283-290)
accgacagcgagacacugagauac

SEQ ID NO: 71320 - RNA, 21 nt, Artificial Sequence
  40S ribosomal protein SA (150-156)
accgacagcccccugagauac

SEQ ID NO: 71321 - RNA, 48 nt, Artificial Sequence
  Carbonic anhydrase 14 (52-67)
accgacagcgugacauucgaucccgaccugccugcccuccagccacac

SEQ ID NO: 71322 - RNA, 30 nt, Artificial Sequence
  CD44 antigen (47-56)
accgaggccgcugaccugugcaaggcauuc

SEQ ID NO: 71323 - RNA, 27 nt, Artificial Sequence
  Rho GTPase-activating protein 5 (467-475)
accgaggccgacagcaaggaaguguac

SEQ ID NO: 71324 - RNA, 30 nt, Artificial Sequence
  Protein kinase C-binding protein 1 (210-219)
accgaggccuuccuggcugacgcaaagugg

SEQ ID NO: 71325 - RNA, 27 nt, Artificial Sequence
  Inosine-5'-monophosphate dehydrogenase 1 isoform f (446-454)
accgaggcccccggcgaauacuucuuu

SEQ ID NO: 71326 - RNA, 33 nt, Artificial Sequence
  Glycogen phosphorylase, muscle form (672-682)
accgaggccagcggcacagggaacaugaaguuc

SEQ ID NO: 71327 - RNA, 30 nt, Artificial Sequence; identical to SEQ ID NO: 47100
  Zinc finger BED domain-containing protein 4 (394-403)

SEQ ID NO: 71328 - RNA, 42 nt, Artificial Sequence
  Large neutral amino acids transporter small subunit 1 (264-277)
accgaggaaaugaucaaccccuacagaaaucugccucucgcc

SEQ ID NO: 71329 - RNA, 21 nt, Artificial Sequence
  Nuclear factor erythroid 2-related factor 1 (9-15)
accgagggccugcuccaguuc

SEQ ID NO: 71330 - RNA, 27 nt, Artificial Sequence
  G-protein coupled receptor 98 (3712-3720)
accgagggccaggugcugagcacaauc

SEQ ID NO: 71331 - RNA, 30 nt, Artificial Sequence
  Fibronectin isoform 7 (376-385)
accgagggcagacaggacgggcaccugugg

SEQ ID NO: 71332 - RNA, 33 nt, Artificial Sequence
  Tribbles homolog 2 (117-127)
accgagaucauucugggcgaaacaaaggccuac

SEQ ID NO: 71333 - RNA, 24 nt, Artificial Sequence
  Flotillin-2 (60-67)
accgagaaggaacugcucgccgug

SEQ ID NO: 71334 - RNA, 33 nt, Artificial Sequence
  Centrosomal protein of 41 kDa (40-50)
accgagaagcuggaagagaucaaaaagaacuac

SEQ ID NO: 71335 - RNA, 33 nt, Artificial Sequence
  Integrin alpha-6 (905-915)
accgagaagcagaucgacgauaacagaaaauuc

SEQ ID NO: 71336 - RNA, 27 nt, Artificial Sequence
  Programmed cell death protein 5 (103-111)
accgagaagacaacuacggugaaauuc

SEQ ID NO: 71337 - RNA, 30 nt, Artificial Sequence
  SH3 domain-binding protein 5 (34-43)
accgagcuggaagacgccagacagaaguuc

SEQ ID NO: 71338 - RNA, 27 nt, Artificial Sequence
  Vesicle-trafficking protein SEC22b (140-148)
accgagcugcaggacgugcaaagaauc

SEQ ID NO: 71339 - RNA, 27 nt, Artificial Sequence
  NHL repeat-containing protein 2 (296-304)
accgagaaccaccugaucagaaagauu

SEQ ID NO: 71340 - RNA, 21 nt, Artificial Sequence
  Zinc finger CCCH domain-containing protein 18 (68-74)
accgagcccuaccacaacuau

SEQ ID NO: 71341 - RNA, 30 nt, Artificial Sequence
  Baculoviral IAP repeat-containing protein 6 (1992-2001)
accgagcagcugagaacaaucauuagguac

SEQ ID NO: 71342 - RNA, 27 nt, Artificial Sequence
  Vacuolar protein sorting-associated protein 13C (969-977)
accgagcagacagugaaggucgccuuc

SEQ ID NO: 71343 - RNA, 27 nt, Artificial Sequence
  Centrosomal protein C10orf90 isoform X1 (20-28)
accgagacagccgugcacagaacuuuc

SEQ ID NO: 71344 - RNA, 27 nt, Artificial Sequence
  Lysosomal-trafficking regulator (2635-2643)
accgagacagaacuggcccagagacuc

SEQ ID NO: 71345 - RNA, 33 nt, Artificial Sequence
  Receptor-type protein tyrosine phosphatase beta (1331-1341)
accgaggugcuggacagccacauccaugccuac

SEQ ID NO: 71346 - RNA, 27 nt, Artificial Sequence
  Apolipoprotein E (36-44)
accgaguggcagagcggccaaagaugg

SEQ ID NO: 71347 - RNA, 27 nt, Artificial Sequence
  Calmodulin-regulated spectrin-associated protein 2 (1318-1326)
accgaguacacaggccccaagcuguau

SEQ ID NO: 71348 - RNA, 27 nt, Artificial Sequence
  Telomeric repeat-binding factor 1 (223-231)
accuuccacagcuuuuuccagcauuuu

SEQ ID NO: 71349 - RNA, 30 nt, Artificial Sequence
  Dolichyl-diphosphooligosaccharide-proteinosyltransferase subunit 2 (266-275)
accuucaucgccgacagccaccagaacuuu

SEQ ID NO: 71350 - RNA, 27 nt, Artificial Sequence
  Phospholipid transfer protein (118-126)
accuucaucacaagcggcaugagauuu

SEQ ID NO: 71351 - RNA, 18 nt, Artificial Sequence
  Ras GTPase-activating-like protein IQGAP1 (1614-1619)
accuucaugcugcacuac

SEQ ID NO: 71352 - RNA, 60 nt, Artificial Sequence
  ATP synthase-coupling factor 6, mitochondrial (89-108)
accuuccccacauuuaaguucgaggacccuaaauuugaagugaucgagaagccacaggcc

SEQ ID NO: 71353 - RNA, 27 nt, Artificial Sequence
  Zinc finger protein 480 (28-36)
accuucagagacguggccaucgaguuu

SEQ ID NO: 71354 - RNA, 27 nt, Artificial Sequence
  Zinc finger protein 98 (14-22)
accuucagagacguggcccuggaguuu

SEQ ID NO: 71355 - RNA, 27 nt, Artificial Sequence
  Zinc finger protein 697 (8-16)
accuucagcguguccucucaccuguuu

SEQ ID NO: 71356 - RNA, 24 nt, Artificial Sequence
  Bestrophin-1 (574-581)
accuucacaggcauccuggggaag

SEQ ID NO: 71357 - RNA, 30 nt, Artificial Sequence
  Glyceraldehyde-3-phosphate dehydrogenase (211-220)
accggcgccgcuaaggcaguggggaaaguc

SEQ ID NO: 71358 - RNA, 45 nt, Artificial Sequence
  4F2 cell-surface antigen heavy chain (120-134)
accggcgcccuguacagaaucggggaccuccaggcuuuccaagga

SEQ ID NO: 71359 - RNA, 21 nt, Artificial Sequence
  Glia-derived nexin (397-403)
accggcgccgugcuguucaug

SEQ ID NO: 71360 - RNA, 27 nt, Artificial Sequence
  DNA-dependent protein kinase catalytic subunit (402-410)
accggcgacgauagaguguaccagaug

SEQ ID NO: 71361 - RNA, 27 nt, Artificial Sequence
  Hsp90 co-chaperone Cdc37 (370-378)
accggcgacgagaaggaugugagcguc

SEQ ID NO: 71362 - RNA, 27 nt, Artificial Sequence
  Ubiquitin carboxyl-terminal hydrolase 8 (508-516)
accggcgacgugccccacacaagcguc

SEQ ID NO: 71363 - RNA, 42 nt, Artificial Sequence
  Basement membrane-specific heparan sulfate proteoglycan core protein (351-364)
accggcgaguucacaguggaacccgucccugagggggcccag

SEQ ID NO: 71364 - RNA, 33 nt, Artificial Sequence
  Titin (7053-7063)
accggcggggugcugggagccagcugcauccuc

SEQ ID NO: 71365 - RNA, 42 nt, Artificial Sequence
  Transferrin receptor protein 1 (518-531)
accggccaguuccuguaccaagacagcaacugggccuccaag

SEQ ID NO: 71366 - RNA, 54 nt, Artificial Sequence
  Beta-secretase 2 (111-128)
accggcagcuccaacuucgccguggcugggacaccccacucuuacaucgacacu

SEQ ID NO: 71367 - RNA, 99 nt, Artificial Sequence
  Histone-lysine N-methyltransferase, H3 lysine-36 and H4 lysine-20 specific (2131-2163)
acccaccuggccgagcagagcacaggcauggcugcacaagcccccaagauguccgacaaaccuccagcggauacuaaccagaugcucucucuuucaaag

SEQ ID NO: 71368 - RNA, 27 nt, Artificial Sequence
  Ras GTPase-activating-like protein IQGAP1 (446-454)
acccaccccgagcugagcguggccguc

SEQ ID NO: 71369 - RNA, 27 nt, Artificial Sequence
  Phosphatidylinositol 4-kinase alpha (399-407)
accaucgacgccgaugcucccgagcug

SEQ ID NO: 71370 - RNA, 24 nt, Artificial Sequence
  Protein prune homolog 2 (1960-1967)
accaucgacgauaugagcaagcug

SEQ ID NO: 71371 - RNA, 24 nt, Artificial Sequence
  DNA damage-binding protein 1 (703-710)
accaucgacgagauucagaagcug

SEQ ID NO: 71372 - RNA, 24 nt, Artificial Sequence
  Calmodulin (66-73)
accaucgacuuccccgaguuucug

SEQ ID NO: 71373 - RNA, 24 nt, Artificial Sequence
  Filamin-A (2133-2140)
accaucgacggccccagcaaggug

SEQ ID NO: 71374 - RNA, 27 nt, Artificial Sequence
  Coatomer subunit alpha (591-599)
accaucgaccccacagaguucaaguuu

SEQ ID NO: 71375 - RNA, 27 nt, Artificial Sequence
  Alpha-actinin-1 (506-514)
accaucgaccagcuguaccucgaguau

SEQ ID NO: 71376 - RNA, 24 nt, Artificial Sequence
  HEAT repeat-containing protein 1 (38-45)
accaucgacagagauacagccuuc

SEQ ID NO: 71377 - RNA, 33 nt, Artificial Sequence
  Melanoma-associated antigen C2 (347-357)
accaucgacacagccgaugacgcuacugugaug

SEQ ID NO: 71378 - RNA, 27 nt, Artificial Sequence
  Vascular endothelial growth factor receptor 2 (1076-1084)
accaucuucgacagaguguacacaauu

SEQ ID NO: 71379 - RNA, 27 nt, Artificial Sequence
  Tripartite motif-containing protein 2 (338-346)
accaucauuggccagcccaugagcgug

SEQ ID NO: 71380 - RNA, 27 nt, Artificial Sequence
  Obscurin-like protein 1 (641-649)
accaucauucagggcacaugguuccug

SEQ ID NO: 71381 - RNA, 36 nt, Artificial Sequence
  Lysosome-associated membraneoprotein 1 (247-258)
accauccugcccgacgccagagauccugcuuucaag

SEQ ID NO: 71382 - RNA, 27 nt, Artificial Sequence
  Eukaryotic translation initiation factor 3 subunit A (435-443)
accauccugagacuccuucagcaagug

SEQ ID NO: 71383 - RNA, 27 nt, Artificial Sequence
  Putative ATP-dependent RNA helicase DHX30 (700-708)
accaucaacgacauugugcacgucguu

SEQ ID NO: 71384 - RNA, 27 nt, Artificial Sequence
  Chloride intracellular channel protein 1 (198-206)
accauccccgaggccuucagaggcgug

SEQ ID NO: 71385 - RNA, 27 nt, Artificial Sequence
  Lysosomal-trafficking regulator (1800-1808)
accauccagggcauucugcacgagaua

SEQ ID NO: 71386 - RNA, 27 nt, Artificial Sequence
  Plexin-B3 (1547-1555)
accaucacacaggugaaggagaaaguc

SEQ ID NO: 71387 - RNA, 30 nt, Artificial Sequence
  Serine/threonine-protein kinase DCLK1 (231-240)
accaucguggacggcccccuguacacaguc

SEQ ID NO: 71388 - RNA, 27 nt, Artificial Sequence
  Phosphopantothenoylcysteine decarboxylase (109-117)
accaucguggacaaggucaaagagguu

SEQ ID NO: 71389 - RNA, 33 nt, Artificial Sequence
  Heat shock protein HSP 90-alpha (90-100)
accaucguggacacaggcauugggaugacuaag

SEQ ID NO: 71390 - RNA, 27 nt, Artificial Sequence
  Mitotic checkpoint serine/threonine-protein kinase BUB1 beta (868-876)
accaucguggagaugcugcacaaggcc

SEQ ID NO: 71391 - RNA, 33 nt, Artificial Sequence
  Heat shock 70 kDa protein 13 (95-105)
accaucuacgacgccaagagauucauuggcaaa

SEQ ID NO: 71392 - RNA, 27 nt, Artificial Sequence
  Probable dolichyl pyrophosphate Glc1Man9GlcNAc2 alpha-1,3-glucosyltransferase (438-446)
accaucuacagcauuuccucucugaag

SEQ ID NO: 71393 - RNA, 81 nt, Artificial Sequence
  Activating signal cointegrator 1 complex subunit 3 (112-138)
accaaggccaucaaacagauguucggccccuuuccuagcuccucugcuacagcagccugcaacgcgacuaauagaauuaua

SEQ ID NO: 71394 - RNA, 81 nt, Artificial Sequence
  Transmembrane protease serine 9 (436-462)
accaaggccagcaugccccuggcuccuacaauggcaccagccccggcggcucccuccacugccuggccuacgucuccagag

SEQ ID NO: 71395 - RNA, 27 nt, Artificial Sequence
  Protein kinase C delta type (402-410)
acccuggccgcugagaaccccuuccuc

SEQ ID NO: 71396 - RNA, 27 nt, Artificial Sequence
  Hexokinase-2 (389-397)
acccuggccgcugugcuccagagaauc

SEQ ID NO: 71397 - RNA, 27 nt, Artificial Sequence
  Protein SOGA1 (670-678)
acccuggccgacaugaaggugacacuc

SEQ ID NO: 71398 - RNA, 27 nt, Artificial Sequence
  Ethanolaminephosphotransferase 1 (355-363)
acccuggcccacauccauuacggcgug

SEQ ID NO: 71399 - RNA, 30 nt, Artificial Sequence
  WD repeat-containing protein 73 (144-153)
acccuggcccccggcgugcuccacggggcu

SEQ ID NO: 71400 - RNA, 27 nt, Artificial Sequence
  Protein kinase C delta-binding protein (77-85)
acccuggcccagcuccuugcuaaggca

SEQ ID NO: 71401 - RNA, 33 nt, Artificial Sequence
  E3 ubiquitin-protein ligase UBR4 (345-355)
acccuggacgccgcuaucagcaaggugcagguc

SEQ ID NO: 71402 - RNA, 27 nt, Artificial Sequence
  Melanoma-associated antigen C2 (140-148)
acccuggacgagaagguggccgaacuc

SEQ ID NO: 71403 - RNA, 27 nt, Artificial Sequence
  Lysine-specific demethylase 5C (1342-1350)
acccuggacgagaaccacagcaucccc

SEQ ID NO: 71404 - RNA, 30 nt, Artificial Sequence
  Calcium-dependent secretion activator 2 (651-660)
acccuggaccacagacucaacgauagcuac

SEQ ID NO: 71405 - RNA, 24 nt, Artificial Sequence
  Rho guanine nucleotide exchange factor 2 (487-494)
acccuggacaagcccagcgugguc

SEQ ID NO: 71406 - RNA, 27 nt, Artificial Sequence
  Alpha-mannosidase 2C1 (688-696)
acccuggacaacggcaucauuagagug

SEQ ID NO: 71407 - RNA, 27 nt, Artificial Sequence
  RING finger protein 150 (368-376)
acccuggaccccgccgugagaacaguc

SEQ ID NO: 71408 - RNA, 27 nt, Artificial Sequence
  Proteinase-activated receptor 1 (37-45)
acccuggaccccagaagcuuccuccuu

SEQ ID NO: 71409 - RNA, 24 nt, Artificial Sequence
  Eukaryotic initiation factor 4A-I (242-249)
acccuggagggcaucagacaguuc

SEQ ID NO: 71410 - RNA, 45 nt, Artificial Sequence
  Kin of IRRE-like protein 1 (337-351)
acccuggagagauacacaguggaaaggacuaacagcggcuccggg

SEQ ID NO: 71411 - RNA, 27 nt, Artificial Sequence
  TBC1 domain family member 4 (1082-1090)
acccuguucgccagccaguuuucccuc

SEQ ID NO: 71412 - RNA, 27 nt, Artificial Sequence
  Centrosomal protein C10orf90 (172-180)
acccuguuccaggcccccccugcucuc

SEQ ID NO: 71413 - RNA, 33 nt, Artificial Sequence
  Ubiquitin carboxyl-terminal hydrolase 11 (92-102)
acccuguuccaggacgagaucaacuggagacuc

SEQ ID NO: 71414 - RNA, 27 nt, Artificial Sequence
  Transmembraneoprotein NMB (202-210)
acccugggcccccagcucauggaggug

SEQ ID NO: 71415 - RNA, 30 nt, Artificial Sequence
  Transmembrane channel-like protein 4 (331-340)
acccugggccagcaagccagaguguggcuc

SEQ ID NO: 71416 - RNA, 24 nt, Artificial Sequence
  E3 ubiquitin-protein ligase TRIP12 (804-811)
acccugggcagaguguacacaauc

SEQ ID NO: 71417 - RNA, 24 nt, Artificial Sequence
  Ubiquitin-60S ribosomal protein L40 (71-78)
acccugcaccucgugcuuagacug

SEQ ID NO: 71418 - RNA, 27 nt, Artificial Sequence
  Alpha-adducin (222-230)
acccugcacagcgccaucuacgcugca

SEQ ID NO: 71419 - RNA, 27 nt, Artificial Sequence
  Peptidyl-tRNA hydrolase 2, mitochondrial (125-133)
acccugaucgcccuccuugcucacgca

SEQ ID NO: 71420 - RNA, 27 nt, Artificial Sequence
  Nebulin (5609-5617)
acccugaucgagagcgaccucaaguac

SEQ ID NO: 71421 - RNA, 33 nt, Artificial Sequence
  Ethanolamine-phosphate phospho-lyase (355-365)
acccugaucggcgacauuagagggauaggacuc

SEQ ID NO: 71422 - RNA, 27 nt, Artificial Sequence
  COP9 signalosome complex subunit 7a (29-37)
acccugauccaccaggugcucgaggcc

SEQ ID NO: 71423 - RNA, 27 nt, Artificial Sequence
  Translocating chain-associated membrane protein 1 (264-272)
acccugauccucagcgugcuuacaguc

SEQ ID NO: 71424 - RNA, 27 nt, Artificial Sequence
  Essential MCU regulator, mitochondrial (82-90)
acccugaucagcaagaacuucgccgcu

SEQ ID NO: 71425 - RNA, 42 nt, Artificial Sequence
  Ryanodine receptor 1 (3790-3803)
acccugaagcucggcaucagcauucuuaacgggggaaaugcc

SEQ ID NO: 71426 - RNA, 30 nt, Artificial Sequence
  General transcription factor IIH subunit 3 (90-99)
acccugcucgccggcagccuugcuaaggca

SEQ ID NO: 71427 - RNA, 36 nt, Artificial Sequence
  ETS translocation variant 5 (376-387)
acccugcucgacgaucccgccaacgcucacuucauc

SEQ ID NO: 71428 - RNA, 27 nt, Artificial Sequence
  Protein kinase C delta-binding protein (27-35)
acccugcucgagaagcuugccagcaug

SEQ ID NO: 71429 - RNA, 27 nt, Artificial Sequence
  Spermatogenesis-associated protein 20 (211-219)
acccugcucgagaacagccagagagug

SEQ ID NO: 71430 - RNA, 27 nt, Artificial Sequence
  E3 ubiquitin-protein ligase HERC2 (204-212)
acccugcucgagagcauccagcacgug

SEQ ID NO: 71431 - RNA, 27 nt, Artificial Sequence
  Putative WAS protein family homolog 3 (362-370)
acccugcucgagagcaucagacaggcc

SEQ ID NO: 71432 - RNA, 27 nt, Artificial Sequence
  WD repeat-containing protein 26 (56-64)
acccugcucggcaucauugugagaaug

SEQ ID NO: 71433 - RNA, 78 nt, Artificial Sequence
  Vimentin (275-300)
acccugcucaucaagacaguggagacuagagacggccaggucauuaacgaaacgagccaacaccaugaugaccuugag

SEQ ID NO: 71434 - RNA, 27 nt, Artificial Sequence
  Maltase-glucoamylase (871-879)
acccugcuccccuaccuuuauacacug

SEQ ID NO: 71435 - RNA, 27 nt, Artificial Sequence
  Vacuolar protein-sorting-associated protein 25 (148-156)
acccugcucagagcccuucaggcucug

SEQ ID NO: 71436 - RNA, 27 nt, Artificial Sequence
  Histone acetyltransferase KAT2B (310-318)
acccugcucagaagcguguucacaguc

SEQ ID NO: 71437 - RNA, 33 nt, Artificial Sequence
  Importin-7 (679-689)
acccugcucagcgacacaaaguaccuugagaug

SEQ ID NO: 71438 - RNA, 27 nt, Artificial Sequence
  Integrator complex subunit 2 (1086-1094)
acccugcucacagugcuuacucaggcc

SEQ ID NO: 71439 - RNA, 33 nt, Artificial Sequence
  Rho GTPase-activating protein 7 (136-146)
acccugauggaccucagcgagagacaggaagug

SEQ ID NO: 71440 - RNA, 21 nt, Artificial Sequence
  Glutamine-fructose-6-phosphate aminotransferase (isomerizing) 1 (429-435)
acccugaugggccucagauac

SEQ ID NO: 71441 - RNA, 27 nt, Artificial Sequence
  Ubiquitin conjugation factor E4 B (1239-1247)
acccugaugacagaccccgugagacuc

SEQ ID NO: 71442 - RNA, 27 nt, Artificial Sequence
  Nuclear factor related to kappa-B-binding protein (308-316)
acccugaacgacaucaugacaagagug

SEQ ID NO: 71443 - RNA, 27 nt, Artificial Sequence
  EMILIN-1 (236-244)
acccugaacgagauccagcaccaacuc

SEQ ID NO: 71444 - RNA, 27 nt, Artificial Sequence
  Kelch-like protein 21 (467-475)
acccugaacggccucauguacuucgug

SEQ ID NO: 71445 - RNA, 33 nt, Artificial Sequence
  Nuclear pore complex protein Nup214 (188-198)
acccugcccagcacaguggccgucacuuccguu

SEQ ID NO: 71446 - RNA, 27 nt, Artificial Sequence
  Nuclear mitotic apparatus protein 1 (151-159)
acccugcaggaggcccucgcucacgca

SEQ ID NO: 71447 - RNA, 27 nt, Artificial Sequence
  DENN domain-containing protein 5A (930-938)
acccugcaggaguucaacaucacacuc

SEQ ID NO: 71448 - RNA, 27 nt, Artificial Sequence
  Uveal autoantigen with coiled-coil domains and ankyrin repeats (714-722)
acccugcagaaggagaucgaaaaagug

SEQ ID NO: 71449 - RNA, 27 nt, Artificial Sequence
  Glycogen phosphorylase, liver form (95-103)
acccugcagaacacaaugaucaaucuc

SEQ ID NO: 71450 - RNA, 30 nt, Artificial Sequence
  Hemicentin-1 (4435-4444)
acccugcagagccccccuaucauuacacuc

SEQ ID NO: 71451 - RNA, 27 nt, Artificial Sequence
  Interleukin-6 receptor subunit beta (3-11)
acccugcagacauggcucgugcaagcc

SEQ ID NO: 71452 - RNA, 27 nt, Artificial Sequence
  Alpha-actinin-4 (226-234)
acccugagcgacaucaaggcccucauu

SEQ ID NO: 71453 - RNA, 27 nt, Artificial Sequence
  Nucleolar pre-ribosomal-associated protein 1 (546-554)
acccugagcgaggacaugauccuccuu

SEQ ID NO: 71454 - RNA, 27 nt, Artificial Sequence
  Serine/threonine-protein kinase ULK2 (102-110)
acccugagcgaggacacaaucagagug

SEQ ID NO: 71455 - RNA, 27 nt, Artificial Sequence
  Alpha-actinin-1 (426-434)
acccugagcgagaucaaggcccuccuu

SEQ ID NO: 71456 - RNA, 33 nt, Artificial Sequence; identical to SEQ ID NO: 47229
  Ribosomal protein S6 kinase beta-1 (376-386)

SEQ ID NO: 71457 - RNA, 33 nt, Artificial Sequence
  TRPM8 channel-associated factor 1 (309-319)
acccugagcggccuccuugccguggggggaauc

SEQ ID NO: 71458 - RNA, 27 nt, Artificial Sequence
  RRP12-like protein (274-282)
acccugagccacgugcucgucacagcc

SEQ ID NO: 71459 - RNA, 27 nt, Artificial Sequence
  CLIP-associating protein 1 (164-172)
acccugagcaagaucgugccccacauu

SEQ ID NO: 71460 - RNA, 30 nt, Artificial Sequence
  Biorientation of chromosomes in cell division protein 1-like 1 (282-291)
acccugagccccgugaaggccggcccugcu

SEQ ID NO: 71461 - RNA, 42 nt, Artificial Sequence
  Beta-2-microglobulin (85-98)
acccugagccagcccaagaucgugaaaugggacagagauaug

SEQ ID NO: 71462 - RNA, 27 nt, Artificial Sequence
  Laminin subunit gamma-1 (1109-1117)
acccugagcucccagaucucuagacuc

SEQ ID NO: 71463 - RNA, 81 nt, Artificial Sequence
  Heat shock cognate 71 kDa protein (273-299)
acccugagcuccucuacacaggccucaaucgagauugacagucucuacgaaggcauagauuucuauacuagcaucacgaga

SEQ ID NO: 71464 - RNA, 81 nt, Artificial Sequence
  Heat shock 70 kDa protein 1B (273-299)
acccugagcuccucuacacaggccucacucgagaucgacagucuuuucgaaggcauugauuuuuacacuagcauaacgaga

SEQ ID NO: 71465 - RNA, 27 nt, Artificial Sequence
  MAX gene-associated protein (1410-1418)
acccugagcacagugaucuccaagguc

SEQ ID NO: 71466 - RNA, 33 nt, Artificial Sequence
  Semaphorin-4C (57-67)
acccugacagagcccacuggccuccuuuacgug

SEQ ID NO: 71467 - RNA, 27 nt, Artificial Sequence
  Ras GTPase-activating protein 3 (509-517)
acccugacacucaucagcaagacugug

SEQ ID NO: 71468 - RNA, 30 nt, Artificial Sequence
  26S proteasome non-ATPase regulatory subunit 12 (319-328)
acccugguggaggacuacggcauggaacuc

SEQ ID NO: 71469 - RNA, 27 nt, Artificial Sequence
  Aggrecan core protein (1921-1929)
acccugguggagagcgucacacaggcc

SEQ ID NO: 71470 - RNA, 27 nt, Artificial Sequence
  WD repeat-containing protein 5B (36-44)
acccuggugggccacacagaggccguc

SEQ ID NO: 71471 - RNA, 27 nt, Artificial Sequence
  Transcription factor SOX-9 (87-95)
acccuggugcccaugccugucagaguu

SEQ ID NO: 71472 - RNA, 27 nt, Artificial Sequence
  Eukaryotic translation initiation factor 4 gamma 1 (1438-1446)
acccuggugagagcccucaugacagcu

SEQ ID NO: 71473 - RNA, 27 nt, Artificial Sequence
  Cyclin-dependent kinase 3 (165-173)
acccugugguacagagcccccgagauc

SEQ ID NO: 71474 - RNA, 27 nt, Artificial Sequence
  Cyclin-dependent kinase 11B (347-355)
acccugugguacagagcccccgagcuc

SEQ ID NO: 71475 - RNA, 27 nt, Artificial Sequence
  Cyclin-dependent kinase 4 (103-111)
acccugugguacagagcccccgaggug

SEQ ID NO: 71476 - RNA, 33 nt, Artificial Sequence
  Cyclin-dependent kinase 4 (103-113)
acccugugguacagagcccccgaggugcuccuu

SEQ ID NO: 71477 - RNA, 27 nt, Artificial Sequence
  Cyclin-dependent kinase 9 (191-199)
acccugugguacagacccccugagcuc

SEQ ID NO: 71478 - RNA, 27 nt, Artificial Sequence
  Bifunctional lysine-specific demethylase and histidyl-hydroxylase NO66 (625-633)
acccuguacgacaagggccuccuucug

SEQ ID NO: 71479 - RNA, 27 nt, Artificial Sequence
  Ubiquitin-conjugating enzyme E2 G1 (48-56)
acccuguacgagggcgggguguucaag

SEQ ID NO: 71480 - RNA, 27 nt, Artificial Sequence
  Vacuolar protein sorting-associated protein 13B (1255-1263)
accauggccggccccgugccuacaagc

SEQ ID NO: 71481 - RNA, 24 nt, Artificial Sequence
  Insulin receptor substrate 2 (544-551)
accauggacagaccccugagccac

SEQ ID NO: 71482 - RNA, 27 nt, Artificial Sequence
  Polyadenylate-binding protein 1 (489-497)
accaugggccccagaccugccgcugca

SEQ ID NO: 71483 - RNA, 30 nt, Artificial Sequence
  ER membrane protein complex subunit 1 (975-984)
accaugaucacaaagagacuggcccaggug

SEQ ID NO: 71484 - RNA, 24 nt, Artificial Sequence
  Chondroitin sulfate proteoglycan 4 (21-28)
accaugcuggccagacucgcuagc

SEQ ID NO: 71485 - RNA, 27 nt, Artificial Sequence
  Protein wntless homolog (257-265)
accaugaugagcagacccccugugcug

SEQ ID NO: 71486 - RNA, 48 nt, Artificial Sequence
  Cytoplasmic polyadenylation element-binding protein 2 (92-107)
accaugcaggacgagcugcuccuuggccugacacaacagcccgccaga

SEQ ID NO: 71487 - RNA, 27 nt, Artificial Sequence
  Gamma-aminobutyric acid receptor subunit beta-2 (6-14)
accaugacaacuaucaacacgcaccug

SEQ ID NO: 71488 - RNA, 27 nt, Artificial Sequence
  Eukaryotic translation initiation factor 4 gamma 1 (249-257)
accaugacaacuauccagaugagcgug

SEQ ID NO: 71489 - RNA, 21 nt, Artificial Sequence
  Cyclin-dependent kinase 13 (257-263)
accaacaaggugaucacacug

SEQ ID NO: 71490 - RNA, 33 nt, Artificial Sequence
  Ankyrin-3 (871-881)
accaacgugagcgccagauucuggcuggcugac

SEQ ID NO: 71491 - RNA, 27 nt, Artificial Sequence
  Guanine nucleotide exchange factor for Rab-3A (97-105)
acccccgccagcccuaacagagagcug

SEQ ID NO: 71492 - RNA, 39 nt, Artificial Sequence
  Sterol regulatory element-binding protein 1 (959-971)
acccccgccagcuccucuaucgacaaggcugugcagcug

SEQ ID NO: 71493 - RNA, 48 nt, Artificial Sequence
  Clathrin heavy chain 1 (394-409)
acccccgacacaaucagaagguuccagagcgugccugcccaaccaggc

SEQ ID NO: 71494 - RNA, 21 nt, Artificial Sequence
  TRAF2 and NCK-interacting protein kinase (190-196)
acccccgagaucagaaaguac

SEQ ID NO: 71495 - RNA, 24 nt, Artificial Sequence
  Importin-7 (508-515)
acccccuucaucagaccugugaug

SEQ ID NO: 71496 - RNA, 27 nt, Artificial Sequence
  (Pyruvate dehydrogenase (acetyl-transferring))-phosphatase 1, mitochondrial (83-91)
accccccacccugccuacgcuacauuc

SEQ ID NO: 71497 - RNA, 39 nt, Artificial Sequence
  Zinc finger protein 354B (90-102)
acccccaagaugacaaaaagcacucagacgcaagacucc

SEQ ID NO: 71498 - RNA, 24 nt, Artificial Sequence
  ATP-dependent RNA helicase DDX51 (308-315)
accccccugagagugagccucguc

SEQ ID NO: 71499 - RNA, 30 nt, Artificial Sequence
  Homeobox protein TGIF1 (249-258)
acccccccuccaacaccgcccgaccugaac

SEQ ID NO: 71500 - RNA, 63 nt, Artificial Sequence
  Annexin A2 (19-39)
acccccccuagcgccuacggcuccgugaaggcuuauacaaacuucgacgcagagagagaugcc

SEQ ID NO: 71501 - RNA, 33 nt, Artificial Sequence
  Nodal modulator 1 (365-375)
accccccagcuggccgacaucauugcuacaggc

SEQ ID NO: 71502 - RNA, 27 nt, Artificial Sequence
  Glycogen phosphorylase, brain form (48-56)
acccccagagacuacuucuuugcccug

SEQ ID NO: 71503 - RNA, 27 nt, Artificial Sequence
  Sialidase-1 (85-93)
acccccagaggcacacugcucgccuuc

SEQ ID NO: 71504 - RNA, 27 nt, Artificial Sequence
  DNA-directed RNA polymerase III subunit RPC1 (167-175)
acccccagaaacggcgagccucugauc

SEQ ID NO: 71505 - RNA, 27 nt, Artificial Sequence
  E3 ubiquitin-protein ligase RNF169 (410-418)
acccccagaaaccugaauaggagccuc

SEQ ID NO: 71506 - RNA, 27 nt, Artificial Sequence
  Galactose-3-O-sulfotransferase 4 (2-10)
acccccagaagcccuacauccgccuuc

SEQ ID NO: 71507 - RNA, 30 nt, Artificial Sequence
  Rho GTPase-activating protein 7 (170-179)
acccccagaacaaacagcgugaucuccguc

SEQ ID NO: 71508 - RNA, 87 nt, Artificial Sequence
  Beta-2-microglobulin (70-98)
acccccacagagaaggacgaauacgccugcagagugaaccacgucacucugagccagccuaaaaucguuaagugggauagggacaug

SEQ ID NO: 71509 - RNA, 63 nt, Artificial Sequence
  HLA class I histocompatibility antigen, A-1 alpha chain (320-340)
acccaggccgcuagcuccgacucugcacaaggcucagaugugagucugacagccugcaagguc

SEQ ID NO: 71510 - RNA, 33 nt, Artificial Sequence
  NADH dehydrogenase (ubiquinone) iron-sulfur protein 2, mitochondrial (453-463)
acccaggacaucguguucggcgaggucgauaga

SEQ ID NO: 71511 - RNA, 30 nt, Artificial Sequence; identical to SEQ ID NO: 47284
  Myosin-IIIa (288-297)

SEQ ID NO: 71512 - RNA, 42 nt, Artificial Sequence
  Basement membrane-specific heparan sulfate proteoglycan core protein (2340-2353)
acccagcccaucagaauugagccuagcuccucucaaguggcc

SEQ ID NO: 71513 - RNA, 45 nt, Artificial Sequence
  Basement membrane-specific heparan sulfate proteoglycan core protein (2340-2354)
acccagcccaucagaauugagccuagcuccucucaaguggccgaa

SEQ ID NO: 71514 - RNA, 33 nt, Artificial Sequence
  Regulator of nonsense transcripts 1 (44-54)
acccagacacccccuggcgggccaggagguccg

SEQ ID NO: 71515 - RNA, 27 nt, Artificial Sequence
  Cytoplasmic FMR1-interacting protein 1 (680-688)
accagauucaacaagcaguuucuguac

SEQ ID NO: 71516 - RNA, 30 nt, Artificial Sequence
  Alpha-1-syntrophin (178-187)
accagacacggcguggacacacaucuguuc

SEQ ID NO: 71517 - RNA, 30 nt, Artificial Sequence
  Peroxisomal membrane protein PMP34 (90-99)
accagacugaagcuccagggcgccaaauuc

SEQ ID NO: 71518 - RNA, 27 nt, Artificial Sequence
  Maltase-glucoamylase (1080-1088)
accagacugcccagccaguacaucuau

SEQ ID NO: 71519 - RNA, 27 nt, Artificial Sequence
  Protein disulfide-isomerase A5 (45-53)
accagaaacaaugugcugguccucuac

SEQ ID NO: 71520 - RNA, 30 nt, Artificial Sequence
  HLA class I histocompatibility antigen, Cw-7 alpha chain (257-266)
accagacccgccggcgacgggacauuccag

SEQ ID NO: 71521 - RNA, 30 nt, Artificial Sequence
  L-dopachrome tautomerase (68-77)
accagacccuggagcggcccuuacauccug

SEQ ID NO: 71522 - RNA, 27 nt, Artificial Sequence
  Glycerol-3-phosphate acyltransferase 3 (128-136)
accagaacaaacgugaauuuccaguac

SEQ ID NO: 71523 - RNA, 27 nt, Artificial Sequence
  Multiple PDZ domain protein (66-74)
accagcgccacauccaacaucgaguac

SEQ ID NO: 71524 - RNA, 30 nt, Artificial Sequence
  Protein prune homolog 2 (1091-1100)
accagcgacggcaugaacuucacaaaguac

SEQ ID NO: 71525 - RNA, 27 nt, Artificial Sequence
  Bifunctional glutamate/proline-tRNA ligase (269-277)
accagcgaccacuucgagacaaucaug

SEQ ID NO: 71526 - RNA, 27 nt, Artificial Sequence
  ATP-dependent RNA helicase DDX50 (268-276)
accagcgacaagggcuucgugacaaug

SEQ ID NO: 71527 - RNA, 24 nt, Artificial Sequence
  Ubinuclein-2 (527-534)
accagcgacaagccccugauguac

SEQ ID NO: 71528 - RNA, 30 nt, Artificial Sequence
  Beta-1-syntrophin (132-141)
accagcgaccccccuuccucucagucauuc

SEQ ID NO: 71529 - RNA, 24 nt, Artificial Sequence
  Polymerase delta-interacting protein 3 (356-363)
accagcgaccagcccauccugcuc

SEQ ID NO: 71530 - RNA, 27 nt, Artificial Sequence
  HEAT repeat-containing protein 5A (1033-1041)
accagcgagaacgccaagcugcacuac

SEQ ID NO: 71531 - RNA, 30 nt, Artificial Sequence
  HEAT repeat-containing protein 5A (1033-1042)
accagcgagaacgccaagcugcacuacuau

SEQ ID NO: 71532 - RNA, 24 nt, Artificial Sequence
  Nuclear pore complex protein Nup205 (1076-1083)
accagcggccccacaaugagauac

SEQ ID NO: 71533 - RNA, 30 nt, Artificial Sequence; identical to SEQ ID NO: 47306
  GREB1-like protein (1129-1138)

SEQ ID NO: 71534 - RNA, 27 nt, Artificial Sequence
  E3 ubiquitin-protein ligase UBR4 (516-524)
accagcauccagagaauucaaaggcug

SEQ ID NO: 71535 - RNA, 27 nt, Artificial Sequence
  Dolichyl-diphosphooligosaccharide-proteinosyltransferase subunit 1 (228-236)
accagcaugacaagagugaucgagguc

SEQ ID NO: 71536 - RNA, 39 nt, Artificial Sequence
  Treacle protein (596-608)
accagccccgccggcuccucuccugcuguggcaggggga

SEQ ID NO: 71537 - RNA, 24 nt, Artificial Sequence
  Chromodomain Y-like protein (94-101)
accagccccaaggcccuggugauc

SEQ ID NO: 71538 - RNA, 27 nt, Artificial Sequence
  Mitogen-activated protein kinase kinase kinase 14 (448-456)
accagccccagaaucgugccucuguac

SEQ ID NO: 71539 - RNA, 27 nt, Artificial Sequence
  Interferon alpha-inducible protein 27, mitochondrial (12-20)
accagcguggccaaggucguuagagug

SEQ ID NO: 71540 - RNA, 33 nt, Artificial Sequence
  RNA binding protein fox-1 homolog 2 (243-253)
accacagccgcugcauucagaggcgcccaccug

SEQ ID NO: 71541 - RNA, 30 nt, Artificial Sequence
  Transcriptional regulator ATRX (461-470)
accacagccaaggugacuaaagagcuguac

SEQ ID NO: 71542 - RNA, 48 nt, Artificial Sequence
  ATP-citrate synthase (677-692)
accacagacggcguguacgagggggucgccaucggaggugauagauau

SEQ ID NO: 71543 - RNA, 27 nt, Artificial Sequence
  Hemicentin-1 (97-105)
accacagaccccaagaaauuccaguac

SEQ ID NO: 71544 - RNA, 21 nt, Artificial Sequence
  Elongation factor 1-alpha 1 (23-29)
accacaggccaccugaucuac

SEQ ID NO: 71545 - RNA, 27 nt, Artificial Sequence
  Signal-induced proliferation-associated 1-like protein 3 (1102-1110)
accacacccggccacgcccagagccug

SEQ ID NO: 71546 - RNA, 27 nt, Artificial Sequence
  Disabled homolog 2-interacting protein (945-953)
accacacagaagcuggugcucgaguac

SEQ ID NO: 71547 - RNA, 27 nt, Artificial Sequence
  Basement membrane-specific heparan sulfate proteoglycan core protein (3563-3571)
accacacagagccacgugcugcuccuu

SEQ ID NO: 71548 - RNA, 27 nt, Artificial Sequence
  Importin-4 (577-585)
accguggccgagaagagcuucgcuguc

SEQ ID NO: 71549 - RNA, 27 nt, Artificial Sequence
  Nicotinamide phosphoribosyltransferase (220-228)
accguggccggccuggcucucaucaag

SEQ ID NO: 71550 - RNA, 27 nt, Artificial Sequence
  Keratin, type I cytoskeletal 18 (86-94)
accguggacaacgccagaaucguccug

SEQ ID NO: 71551 - RNA, 24 nt, Artificial Sequence
  Signal-induced proliferation-associated 1-like protein 2 (821-828)
accguggacacaagcgucaaguuc

SEQ ID NO: 71552 - RNA, 63 nt, Artificial Sequence
  Vimentin (446-466)
accguggagacaagagacggccaggucaucaacgaaacuagccaacaccaugaugaccuggag

SEQ ID NO: 71553 - RNA, 27 nt, Artificial Sequence
  Runt-related transcription factor 1 (36-44)
accguguucacaaaccccccucagguc

SEQ ID NO: 71554 - RNA, 27 nt, Artificial Sequence
  Proto-oncogene tyrosine-protein kinase receptor Ret (350-358)
accgugcacgacuacagacugguccuc

SEQ ID NO: 71555 - RNA, 48 nt, Artificial Sequence
  Endoplasmin (688-703)
accgugcuggaccucgccgucguucuuuucgagacagcuacucugaga

SEQ ID NO: 71556 - RNA, 27 nt, Artificial Sequence
  Transmembrane protein 9 (177-185)
accgugcuggagagagucgaaggcgcc

SEQ ID NO: 71557 - RNA, 30 nt, Artificial Sequence
  Cytoskeleton-associated protein 5 (947-956)
accgugcugggcgacagcaagaacaauguc

SEQ ID NO: 71558 - RNA, 30 nt, Artificial Sequence
  DNA annealing helicase and endonuclease ZRANB3 (73-82)
accgugcugggcuacgggcuccuuacagcc

SEQ ID NO: 71559 - RNA, 27 nt, Artificial Sequence
  HEAT repeat-containing protein 1 (1553-1561)
accgugcugggcuacaucagcgccguc

SEQ ID NO: 71560 - RNA, 45 nt, Artificial Sequence
  Actin, cytoplasmic 2 (36-50)
accgugcugagcggcgggacaacuauguaccccggaaucgccgac

SEQ ID NO: 71561 - RNA, 27 nt, Artificial Sequence
  Neuron navigator 2 (1903-1911)
accgugaugcagcugagaaacgagcuc

SEQ ID NO: 71562 - RNA, 27 nt, Artificial Sequence
  Ryanodine receptor 2 (3867-3875)
accgugaacaucauuauaagcacaguc

SEQ ID NO: 71563 - RNA, 90 nt, Artificial Sequence
  Fructose-bisphosphate aldolase A (314-343)
accgugcccccugccgucacaggcaucacuuuccugagcgggggacaguccgaggaagaggcuucuauuaaccucaaugcaauaaacaag

SEQ ID NO: 71564 - RNA, 27 nt, Artificial Sequence
  Mucin-16 (11203-11211)
accgugcagggccuggucacaagccuc

SEQ ID NO: 71565 - RNA, 84 nt, Artificial Sequence
  Nucleophosmin (46-73)
accgugagccugggcgccggggcuaaggacgagcuccacaucgucgaagcagaggccaugaacuacgaaggaucccccauuaaa

SEQ ID NO: 71566 - RNA, 33 nt, Artificial Sequence
  Complement C4-A (408-418)
accgugagcucccccggcucugucccugagguu

SEQ ID NO: 71567 - RNA, 27 nt, Artificial Sequence
  Exportin-6 (585-593)
accguggucgagagacugguuaaggug

SEQ ID NO: 71568 - RNA, 33 nt, Artificial Sequence
  U4/U6 small nuclear ribonucleoprotein Prp3 (29-39)
accguggucacagccgcucugaacugcguuggc

SEQ ID NO: 71569 - RNA, 30 nt, Artificial Sequence
  Multidrug resistance-associated protein 7 (941-950)
accguguacgccacaaucgcuggcgucaac

SEQ ID NO: 71570 - RNA, 30 nt, Artificial Sequence
  MMS19 nucleotide excision repair protein homolog (150-159)
accguguacaacaucauuacaaauuucaug

SEQ ID NO: 71571 - RNA, 27 nt, Artificial Sequence
  RNA-binding protein 26 (673-681)
accguguacaaccccgccgcucugaag

SEQ ID NO: 71572 - RNA, 42 nt, Artificial Sequence
  Protein SZT2 (605-618)
accuggggccugccccacgccccuccaagcccggggccccuc

SEQ ID NO: 71573 - RNA, 30 nt, Artificial Sequence
  Tyrosine-protein phosphatase non-receptor type substrate 1 (472-481)
accuacgccgaccuggauauggugcaccuc

SEQ ID NO: 71574 - RNA, 33 nt, Artificial Sequence
  Serine/threonine-protein kinase SMG1 (743-753)
accuacgccccccuguucagccucccuuccuuu

SEQ ID NO: 71575 - RNA, 27 nt, Artificial Sequence
  Muskelin (680-688)
accuacgcccagagaacacaacuguuc

SEQ ID NO: 71576 - RNA, 24 nt, Artificial Sequence
  Low-density lipoprotein receptor-related protein 2 (585-592)
accuacgacggcauccagagaaag

SEQ ID NO: 71577 - RNA, 27 nt, Artificial Sequence
  Diamine acetyltransferase 1 (80-88)
accuacgaccccuggaucggcaagcug

SEQ ID NO: 71578 - RNA, 24 nt, Artificial Sequence
  L-dopachrome tautomerase (302-309)
accuacgagggccugcucagaagg

SEQ ID NO: 71579 - RNA, 27 nt, Artificial Sequence
  GPI-anchor transamidase (386-394)
accuacggcaucaagcacaugaaauuc

SEQ ID NO: 71580 - RNA, 27 nt, Artificial Sequence
  Ral GTPase-activating protein subunit beta (252-260)
accuacggccccagcuucccugccuuu

SEQ ID NO: 71581 - RNA, 27 nt, Artificial Sequence
  Talin-1 (307-315)
accuacggcgugagcuucuuucugguc

SEQ ID NO: 71582 - RNA, 24 nt, Artificial Sequence
  Parafibromin (314-321)
accuaccacggcaugacacugaag

SEQ ID NO: 71583 - RNA, 27 nt, Artificial Sequence
  Down syndrome critical region protein 3 (108-116)
accuaccacggcguguucgucaacauc

SEQ ID NO: 71584 - RNA, 27 nt, Artificial Sequence
  AP-2 complex subunit alpha-1 (544-552)
accuacaucaaguucauuaaccuguuu

SEQ ID NO: 71585 - RNA, 30 nt, Artificial Sequence
  Transmembrane protein 231 (34-43)
accuacauccccccucugcucguggccuuc

SEQ ID NO: 71586 - RNA, 27 nt, Artificial Sequence
  Phosphatidylinositol 4-phosphate 3-kinase C2 domain-containing subunit alpha (731-739)
accuacaagaacuucuuuuaucugauc

SEQ ID NO: 71587 - RNA, 27 nt, Artificial Sequence
  Serine-protein kinase ATM (2359-2367)
accuaccuggagaaggccguggaaguc

SEQ ID NO: 71588 - RNA, 27 nt, Artificial Sequence
  T-complex protein 1 subunit theta (427-435)
accuaccugggcaaguauugggccauc

SEQ ID NO: 71589 - RNA, 27 nt, Artificial Sequence
  G1/S-specific cyclin-E1 (111-119)
accuaccugagagaccagcacuuccuc

SEQ ID NO: 71590 - RNA, 27 nt, Artificial Sequence
  Digestive organ expansion factor homolog (692-700)
accuacccccacuucuauagcgagauc

SEQ ID NO: 71591 - RNA, 27 nt, Artificial Sequence
  Sorbin and SH3 domain-containing protein 2 (215-223)
accuacccccagcacgcccaaagccug

SEQ ID NO: 71592 - RNA, 27 nt, Artificial Sequence
  Exportin-T (46-54)
accuacagcgacgaucacgugaaguuc

SEQ ID NO: 71593 - RNA, 27 nt, Artificial Sequence
  Nuclear receptor subfamily 2 group C member 2 (532-540)
accuacagcgaggacacauauagacug

SEQ ID NO: 71594 - RNA, 27 nt, Artificial Sequence
  SRSF protein kinase 2 (426-434)
accuacagcuccucuuaugagcaguuc

SEQ ID NO: 71595 - RNA, 27 nt, Artificial Sequence
  Cartilage acidic protein 1 (144-152)
accuacacagacaagcuguucaaauuu

SEQ ID NO: 71596 - RNA, 27 nt, Artificial Sequence
  Cation-independent mannose-6-phosphate receptor (884-892)
accuacacaacuagaauccaccuggug

SEQ ID NO: 71597 - RNA, 27 nt, Artificial Sequence
  Cathepsin D (130-138)
accuacgugaagaacggcacaagcuuc

SEQ ID NO: 71598 - RNA, 36 nt, Artificial Sequence
  Protein YIF1B (149-160)
accuacgugcuggucgccggccucgcucuugggaca

SEQ ID NO: 71599 - RNA, 27 nt, Artificial Sequence
  Histone-binding protein RBBP4 (186-194)
guggccgacgaucagaagcugaugauc

SEQ ID NO: 71600 - RNA, 27 nt, Artificial Sequence
  E3 ubiquitin-protein ligase TRIM56 (523-531)
guggccgacgagcagaacagagcucug

SEQ ID NO: 71601 - RNA, 24 nt, Artificial Sequence
  Coatomer subunit gamma-1 (760-767)
guggccgaccacauccagaagguc

SEQ ID NO: 71602 - RNA, 27 nt, Artificial Sequence
  HMG domain-containing protein 4 (317-325)
guggccgaccaccccggcaucgauuuc

SEQ ID NO: 71603 - RNA, 24 nt, Artificial Sequence
  Laminin subunit gamma-1 (1042-1049)
guggccgaccacagagucaagcug

SEQ ID NO: 71604 - RNA, 30 nt, Artificial Sequence
  Catenin beta-1 (79-88)
guggccgacaucgauggccaguacgcuaug

SEQ ID NO: 71605 - RNA, 24 nt, Artificial Sequence
  Dual specificity protein phosphatase 14 (93-100)
guggccgacaagauccacagcguc

SEQ ID NO: 71606 - RNA, 27 nt, Artificial Sequence
  Translin-associated protein X (191-199)
guggccgaccugaccggcgagcucaug

SEQ ID NO: 71607 - RNA, 27 nt, Artificial Sequence
  Neutral alpha-glucosidase AB (23-31)
guggccgaccccccuaucgcuagacug

SEQ ID NO: 71608 - RNA, 27 nt, Artificial Sequence
  Polypeptide N-acetylgalactosaminyltransferase 2 (241-249)
guggccgaggacagaaccagggucguu

SEQ ID NO: 71609 - RNA, 27 nt, Artificial Sequence
  Protein PRR14L (111-119)
guggccgagagcgcugucuccaagcug

SEQ ID NO: 71610 - RNA, 27 nt, Artificial Sequence
  UPF0415 protein C7orf25 (292-300)
guggccuuccccaccgagaucaagguc

SEQ ID NO: 71611 - RNA, 30 nt, Artificial Sequence
  Cytoskeleton-associated protein 5 (883-892)
guggccggcaucauuaacgacgcuaaguuc

SEQ ID NO: 71612 - RNA, 33 nt, Artificial Sequence
  HLA class I histocompatibility antigen, alpha chain F (305-315)
guggccggccuggucguucucggggcuguggua

SEQ ID NO: 71613 - RNA, 24 nt, Artificial Sequence
  Phosphofurin acidic cluster sorting protein 1 (109-116)
guggccggcagagucaugcaguac

SEQ ID NO: 71614 - RNA, 39 nt, Artificial Sequence
  CLIP-associating protein 2 (347-359)
guggccggcagagucagcgcuggguccucuaaggcauca

SEQ ID NO: 71615 - RNA, 30 nt, Artificial Sequence
  CAD protein (1548-1557)
guggccggcagcgcugcagggcugaagcuc

SEQ ID NO: 71616 - RNA, 27 nt, Artificial Sequence
  CLOCK-interacting pacemaker (251-259)
guggccaaggcucccagccugaccuuc

SEQ ID NO: 71617 - RNA, 45 nt, Artificial Sequence
  Glucose-6-phosphate isomerase (250-264)
guggccaagcacuucgucgcucugagcaccaacacaacuaaaguu

SEQ ID NO: 71618 - RNA, 48 nt, Artificial Sequence
  Glucose-6-phosphate isomerase (250-265)
guggccaagcacuucgucgcucugagcaccaacacaacuaaaguuaag

SEQ ID NO: 71619 - RNA, 27 nt, Artificial Sequence
  Proline and serine-rich protein 1 (85-93)
guggcccuggagcuccuugcuagcaac

SEQ ID NO: 71620 - RNA, 33 nt, Artificial Sequence
  Phosphatidylcholine translocator ABCB4 (985-995)
guggcccugggccacgcuagcuccuucgcaccc

SEQ ID NO: 71621 - RNA, 30 nt, Artificial Sequence
  ATP-binding cassette sub-family A member 13 (1236-1245)
guggcccugggcaacgcucucgucagcguu

SEQ ID NO: 71622 - RNA, 27 nt, Artificial Sequence
  Neural cell adhesion molecule L1 (3-11)
guggcccugagauacgucuggccccuc

SEQ ID NO: 71623 - RNA, 24 nt, Artificial Sequence
  Constitutive coactivator of PPAR-gamma-like protein 1 (551-558)
guggcccccgagguccugagaguu

SEQ ID NO: 71624 - RNA, 27 nt, Artificial Sequence
  Glutamate receptor ionotropic, kainate 3 (516-524)
guggccccccugaccaucacacacguc

SEQ ID NO: 71625 - RNA, 27 nt, Artificial Sequence
  Transcription factor p65 (404-412)
guggcccccccugcuccaaagccgacc

SEQ ID NO: 71626 - RNA, 33 nt, Artificial Sequence
  Protein NLRC3 (955-965)
guggccagcaucggcgcuuccggggcacagguc

SEQ ID NO: 71627 - RNA, 24 nt, Artificial Sequence
  Endothelin B receptor (292-299)
guggccagcugguccagaaucaag

SEQ ID NO: 71628 - RNA, 27 nt, Artificial Sequence
  Zinc finger MYM-type protein 4 (1069-1077)
guggccgucgagcccagaagccugauc

SEQ ID NO: 71629 - RNA, 27 nt, Artificial Sequence
  Transient receptor potential cation channel subfamily V member 2 (408-416)
guggccuaccaccagcccacccugaag

SEQ ID NO: 71630 - RNA, 150 nt, Artificial Sequence
  ATP synthase subunit epsilon, mitochondrial (2-51)
guggccuacuggagacaggcuggccugagcuauaucagguacucccaaauuugcgcaaaggccguccgggacgcgcucaaaaccgaguucaaggcuaacgccgaaaaaacaucugggucaaauguuaagauagugaaaguaaagaaggag

SEQ ID NO: 71631 - RNA, 66 nt, Artificial Sequence
  Pyridoxal kinase (153-174)
guggacgccgucuucguuggcaccggggaucuguuugcugcaaugcuccuugccuggacacacaag

SEQ ID NO: 71632 - RNA, 30 nt, Artificial Sequence
  Titin (5174-5183)
guggacgaucugaucgcccucggcgggcag

SEQ ID NO: 71633 - RNA, 54 nt, Artificial Sequence
  HLA class I histocompatibility antigen, B-51 alpha chain (27-44)
guggacgauacccaguucgucagauuugacagcgaugccgcuucccccaggaca

SEQ ID NO: 71634 - RNA, 60 nt, Artificial Sequence
  HLA class I histocompatibility antigen, B-51 alpha chain (27-46)
guggacgauacccaguucgucagauuugacagcgaugccgcuucccccaggacagagccu

SEQ ID NO: 71635 - RNA, 66 nt, Artificial Sequence
  Transducin-like enhancer protein 2 (117-138)
guggacgaggaucagcccagcgaaccuccauccccggccaccacacccugcggcaaggucccuauc

SEQ ID NO: 71636 - RNA, 45 nt, Artificial Sequence
  Annexin A2 (51-65)
guggacgaggucaccaucguuaacauucugacaaauagaagcaac

SEQ ID NO: 71637 - RNA, 51 nt, Artificial Sequence
  Annexin A2 (51-67)
guggacgaggucaccaucguuaacauucugacaaauagaagcaacgcccag

SEQ ID NO: 71638 - RNA, 36 nt, Artificial Sequence
  Glyceraldehyde-3-phosphate dehydrogenase (28-39)
guggacaucgucgccauuaacgaucccuucauagac

SEQ ID NO: 71639 - RNA, 27 nt, Artificial Sequence
  Eukaryotic translation initiation factor 2A (267-275)
guggacaagaccggcgccagcuacuau

SEQ ID NO: 71640 - RNA, 24 nt, Artificial Sequence
  40S ribosomal protein S21 (39-46)
guggacaaggucaccggcagauuc

SEQ ID NO: 71641 - RNA, 60 nt, Artificial Sequence
  Collagen alpha-4(IV) chain (1284-1303)
guggaccugcucagaggcgagcccggggauugcggacuuccugguccaccgggccccccu

SEQ ID NO: 71642 - RNA, 33 nt, Artificial Sequence
  Immunoglobulin superfamily DCC subclass member 4 (828-838)
guggacauggauggccccuucgggagcgucguu

SEQ ID NO: 71643 - RNA, 45 nt, Artificial Sequence
  Multidrug resistance-associated protein 6 (610-624)
guggaccccggcgucguugauagcuccucuucagggagugccgcu

SEQ ID NO: 71644 - RNA, 24 nt, Artificial Sequence
  Histone deacetylase 9 (79-86)
guggaccccgucguuagagagaag

SEQ ID NO: 71645 - RNA, 51 nt, Artificial Sequence
  Neuron navigator 1 (1420-1436)
guggacagccuggucuucgagacccucauccccaagccuaugaugcagcac

SEQ ID NO: 71646 - RNA, 24 nt, Artificial Sequence
  Microtubule-actin cross-linking factor 1, isoforms 1/2/3/5 (329-336)
guggacagcagauggcaggaguac

SEQ ID NO: 71647 - RNA, 60 nt, Artificial Sequence
  Beta-secretase 2 (109-128)
guggacaccggcagcuccaacuucgccgucgcugggacaccccacucuuacaucgauacu

SEQ ID NO: 71648 - RNA, 33 nt, Artificial Sequence; identical to SEQ ID NO: 47421
  Probable C-mannosyltransferase DPY19L1 (75-85)

SEQ ID NO: 71649 - RNA, 36 nt, Artificial Sequence
  Dynein heavy chain 17, axonemal (1541-1552)
guggaggccaccagcaagcccggccuguacaacaaa

SEQ ID NO: 71650 - RNA, 27 nt, Artificial Sequence
  Putative RNA-binding protein 15 (166-174)
guggaggacggccuguuccacgaauuu

SEQ ID NO: 71651 - RNA, 27 nt, Artificial Sequence
  Protein phosphatase 1 regulatory subunit 12B (100-108)
guggaggaagacagcaacagagauuac

SEQ ID NO: 71652 - RNA, 30 nt, Artificial Sequence
  Protrudin (99-108)
guggaguucuuuagagucguuagcgaauac

SEQ ID NO: 71653 - RNA, 30 nt, Artificial Sequence; identical to SEQ ID NO: 47426
  Glycogen phosphorylase, brain form (207-216)

SEQ ID NO: 71654 - RNA, 21 nt, Artificial Sequence
  CDK5 regulatory subunit-associated protein 1 (383-389)
guggagcugguccaccauauc

SEQ ID NO: 71655 - RNA, 27 nt, Artificial Sequence
  Chondroitin sulfate glucuronyltransferase (720-728)
guggagcccggccugguccagaaguuc

SEQ ID NO: 71656 - RNA, 39 nt, Artificial Sequence
  Beta-hexosaminidase subunit alpha (437-449)
guggagccccuggccuucgaaggcaccccugagcagaag

SEQ ID NO: 71657 - RNA, 42 nt, Artificial Sequence
  40S ribosomal protein S18 (64-77)
guggagagagucaucaccauuaugcagaaccccaggcaauac

SEQ ID NO: 71658 - RNA, 45 nt, Artificial Sequence
  40S ribosomal protein S18 (64-78)
guggagagagucaucaccauuaugcagaaccccaggcaauacaag

SEQ ID NO: 71659 - RNA, 27 nt, Artificial Sequence
  Myoferlin (1325-1333)
guggagagcgucguuaucaagaaccug

SEQ ID NO: 71660 - RNA, 60 nt, Artificial Sequence
  Vimentin (447-466)
guggagaccagagacggccaggucaucaacgaaacaagccaacaccaugaugaccuggag

SEQ ID NO: 71661 - RNA, 48 nt, Artificial Sequence
  HLA class I histocompatibility antigen, Cw-7 alpha chain (255-270)
guggagaccagacccgccggcgacgggacauuccagaagugggcugca

SEQ ID NO: 71662 - RNA, 27 nt, Artificial Sequence
  Integrin beta-5 (441-449)
guguucgcccugagacccgucggcuuu

SEQ ID NO: 71663 - RNA, 27 nt, Artificial Sequence
  Ribosomal protein S6 kinase alpha-5 (487-495)
guguuccacgaccagcugcauaccuuu

SEQ ID NO: 71664 - RNA, 27 nt, Artificial Sequence
  Nuclear factor erythroid 2-related factor 3 (266-274)
guguuccacaaccauaccuaccaccug

SEQ ID NO: 71665 - RNA, 27 nt, Artificial Sequence
  Integrin alpha-7 (708-716)
guguucaucgagcugccccucagcauu

SEQ ID NO: 71666 - RNA, 27 nt, Artificial Sequence
  Leucine-rich repeat serine/threonine-protein kinase 2 (619-627)
guguucaucggcaccgggcaccugcuc

SEQ ID NO: 71667 - RNA, 30 nt, Artificial Sequence
  Putative pre-mRNA-splicing factor ATP-dependent RNA helicase DHX16 (968-977)
guguucauccaccccaacagcucccuguuu

SEQ ID NO: 71668 - RNA, 27 nt, Artificial Sequence
  E3 ubiquitin-protein ligase RNF213 (400-408)
guguucaucagaggcggggaggaauuu

SEQ ID NO: 71669 - RNA, 27 nt, Artificial Sequence
  Receptor-type tyrosine-protein phosphatase zeta (120-128)
guguucaaggccagcaaaaucaccuuu

SEQ ID NO: 71670 - RNA, 27 nt, Artificial Sequence
  Baculoviral IAP repeat-containing protein 6 (448-456)
guguucaagcccaucagcuccaccugg

SEQ ID NO: 71671 - RNA, 24 nt, Artificial Sequence
  Farnesyl pyrophosphate synthase (333-340)
guguuccugggccucgccagaaag

SEQ ID NO: 71672 - RNA, 33 nt, Artificial Sequence
  Transmembraneoprotein NMB (543-553)
guguuccugaacagagccaaggcugucuuuuuc

SEQ ID NO: 71673 - RNA, 30 nt, Artificial Sequence
  HLA class II histocompatibility antigen, DQ alpha 1 chain (162-171)
guguuccugcccagagaggaccaccucuuu

SEQ ID NO: 71674 - RNA, 33 nt, Artificial Sequence
  Extracellular matrix protein FRAS1 (2887-2897)
guguuccugagcuccgcccagggcgcugagcuc

SEQ ID NO: 71675 - RNA, 27 nt, Artificial Sequence
  Beta-hexosaminidase subunit alpha (311-319)
guguuccccgacuuuuaccugcaccuc

SEQ ID NO: 71676 - RNA, 27 nt, Artificial Sequence
  Sal-like protein 1 (304-312)
guguuccccagcccucugccaaacauc

SEQ ID NO: 71677 - RNA, 27 nt, Artificial Sequence
  Lysosomal-trafficking regulator (976-984)
guguuccagaagcaauuuuacagacug

SEQ ID NO: 71678 - RNA, 27 nt, Artificial Sequence
  Filamin-A (1243-1251)
guguucagagaggccaccacagaauuu

SEQ ID NO: 71679 - RNA, 27 nt, Artificial Sequence
  Tubulin beta chain (336-344)
guguucagaggcaggaugagcaugaag

SEQ ID NO: 71680 - RNA, 30 nt, Artificial Sequence
  Transformation/transcription domain-associated protein (638-647)
guguucaccaugaugaacccccugacauuu

SEQ ID NO: 71681 - RNA, 27 nt, Artificial Sequence
  Cell division cycle protein 23 homolog (185-193)
guguucgucgaggccacccacguucug

SEQ ID NO: 71682 - RNA, 33 nt, Artificial Sequence
  Delphilin (267-277)
gugggcgggcuggccggacccgguggcgcuaga

SEQ ID NO: 71683 - RNA, 21 nt, Artificial Sequence
  Peroxisomal membrane protein 2 (69-75)
gugggcgggccccugagauac

SEQ ID NO: 71684 - RNA, 27 nt, Artificial Sequence
  Eukaryotic translation initiation factor 6 (64-72)
gugggcaacagacacgggcugcucguc

SEQ ID NO: 71685 - RNA, 27 nt, Artificial Sequence
  Nuclear factor of activated T-cells, cytoplasmic 2 (274-282)
gugggcaacaccaagguccuggagauc

SEQ ID NO: 71686 - RNA, 45 nt, Artificial Sequence
  Filamin-A (1151-1165)
gugggccaguuccaagucgacugcagcuccgccgggucugcugag

SEQ ID NO: 71687 - RNA, 33 nt, Artificial Sequence
  Cullin-4A (15-25)
gugggcagaaccaacgggcugacaaagcccgcc

SEQ ID NO: 71688 - RNA, 24 nt, Artificial Sequence
  F-box only protein 3 (82-89)
gugggcagauacaucgaccacuau

SEQ ID NO: 71689 - RNA, 39 nt, Artificial Sequence
  HLA class I histocompatibility antigen, B-13 alpha chain (24-36)
gugggcuacgucgacgauacccaguucguuagauuugac

SEQ ID NO: 71690 - RNA, 27 nt, Artificial Sequence
  Lysosomal-trafficking regulator (893-901)
gugcacaucaacaccauuaaucuguuc

SEQ ID NO: 71691 - RNA, 21 nt, Artificial Sequence
  Bax inhibitor 1 (93-99)
gugcacauggucacccauuuc

SEQ ID NO: 71692 - RNA, 27 nt, Artificial Sequence
  Sterol 26-hydroxylase, mitochondrial (181-189)
gugaucgacgauuucaugaccagacug

SEQ ID NO: 71693 - RNA, 30 nt, Artificial Sequence
  Keratin, type I cytoskeletal 18 (130-139)
gugaucgacgauaccaacauuacaagacug

SEQ ID NO: 71694 - RNA, 27 nt, Artificial Sequence
  Laminin subunit alpha-4 (1790-1798)
gugaucgacggccaccccgucagcuuc

SEQ ID NO: 71695 - RNA, 24 nt, Artificial Sequence
  Prefoldin subunit 1 (20-27)
gugaucgacacccagcaaaagguc

SEQ ID NO: 71696 - RNA, 27 nt, Artificial Sequence
  Protein PRRC2C (1668-1676)
gugaucgaggacccccagagcaaccug

SEQ ID NO: 71697 - RNA, 27 nt, Artificial Sequence
  Helicase SKI2W (419-427)
gugaucuucgacgagguccacuacauu

SEQ ID NO: 71698 - RNA, 63 nt, Artificial Sequence
  Dolichyl-diphosphooligosaccharide-proteinosyltransferase 48 kDa subunit (255-275)
gugaucuucagcggcucccuggacuuuuucucugauucauuuuucaacagugccguccagaag

SEQ ID NO: 71699 - RNA, 27 nt, Artificial Sequence
  CLIP-associating protein 1 (218-226)
gugaucuucaccaaguuugacgagguc

SEQ ID NO: 71700 - RNA, 24 nt, Artificial Sequence
  Tyrosine-protein phosphatase non-receptor type 13 (1869-1876)
gugaucggcagaguccuggagcuc

SEQ ID NO: 71701 - RNA, 72 nt, Artificial Sequence
  Glyceraldehyde-3-phosphate dehydrogenase (163-186)
gugauccacgacaacuucggcauugucgaggggcugaugaccacaguucaugccauaacugcuacgcagaag

SEQ ID NO: 71702 - RNA, 24 nt, Artificial Sequence
  ELAV-like protein 1 (102-109)
gugaucaaggacgccaaccuguac

SEQ ID NO: 71703 - RNA, 21 nt, Artificial Sequence
  U5 small nuclear ribonucleoprotein 200 kDa helicase (1232-1238)
gugauccugcaccaugaguac

SEQ ID NO: 71704 - RNA, 48 nt, Artificial Sequence
  Heat shock protein HSP 90-beta (107-122)
gugauccugcaccucaaggaggaccagaccgaauaccuugaggaaaga

SEQ ID NO: 71705 - RNA, 27 nt, Artificial Sequence
  Zinc finger BED domain-containing protein 1 (183-191)
gugauccugaaggagcucgccgaagcu

SEQ ID NO: 71706 - RNA, 27 nt, Artificial Sequence
  Natural resistance-associated macrophage protein 2 (259-267)
gugaucaugccccacaacauguaccug

SEQ ID NO: 71707 - RNA, 39 nt, Artificial Sequence
  Vimentin (454-466)
gugaucaacgagaccagccagcaccaugacgaucuggaa

SEQ ID NO: 71708 - RNA, 27 nt, Artificial Sequence
  NEDD8 ultimate buster 1 (130-138)
gugaucaacaagaaacagcugcaacuc

SEQ ID NO: 71709 - RNA, 27 nt, Artificial Sequence
  Spectrin beta chain, non-erythrocytic 1 (2228-2236)
gugaucaacaaucaggagaugggcuuc

SEQ ID NO: 71710 - RNA, 30 nt, Artificial Sequence
  Glia-derived nexin (64-73)
gugaucagcccccacggcauugccuccguc

SEQ ID NO: 71711 - RNA, 27 nt, Artificial Sequence
  Serine-protein kinase ATM (120-128)
gugaucuacacccugauucacuauaua

SEQ ID NO: 71712 - RNA, 27 nt, Artificial Sequence
  Protein-L-isoaspartate(D-aspartate) O-methyltransferase (92-100)
gugaucuacgucccccugaccgacaag

SEQ ID NO: 71713 - RNA, 30 nt, Artificial Sequence
  Collagen alpha-1(XII) chain (423-432)
gugaagggcgcccccagaaaccugaaaguc

SEQ ID NO: 71714 - RNA, 27 nt, Artificial Sequence
  Transferrin receptor protein 1 (188-196)
gugaagauccaggucaaagacagcgcc

SEQ ID NO: 71715 - RNA, 51 nt, Artificial Sequence
  Protocadherin Fat 3 (438-454)
gugaagaaagaggucuacaagcuggaaguuaccaacaaagagggcgaccuc

SEQ ID NO: 71716 - RNA, 48 nt, Artificial Sequence
  Gamma-secretase C-terminal fragment 59 (559-574)
gugaagauggacgccgaguucagacacgauagcggcuacgaaguccau

SEQ ID NO: 71717 - RNA, 51 nt, Artificial Sequence
  Gamma-secretase C-terminal fragment 59 (559-575)
gugaagauggacgccgaguucagacacgauagcggcuacgaaguccaucac

SEQ ID NO: 71718 - RNA, 54 nt, Artificial Sequence
  Gamma-secretase C-terminal fragment 59 (559-576)
gugaagauggacgccgaguucagacacgauagcggcuacgaaguccaucaccag

SEQ ID NO: 71719 - RNA, 30 nt, Artificial Sequence
  Small conductance calcium-activated potassium channel protein 2 (419-428)
gugaagaacgccgcugcaaauguccugaga

SEQ ID NO: 71720 - RNA, 33 nt, Artificial Sequence; identical to SEQ ID NO: 47493
  Intraflagellar transport protein 81 homolog (41-51)

SEQ ID NO: 71721 - RNA, 27 nt, Artificial Sequence
  Rootletin (677-685)
gugcuggccaaggagcucgucgaaguu

SEQ ID NO: 71722 - RNA, 27 nt, Artificial Sequence
  Protein FAM13B (15-23)
gugcuggccaacaagaucuucggcauu

SEQ ID NO: 71723 - RNA, 27 nt, Artificial Sequence
  A-kinase anchor protein 1, mitochondrial (363-371)
gugcuggccaccacagucggcaagguu

SEQ ID NO: 71724 - RNA, 33 nt, Artificial Sequence
  Laminin subunit gamma-1 (20-30)
gugcuggccguccucgcugcagccgcggcugcc

SEQ ID NO: 71725 - RNA, 30 nt, Artificial Sequence
  U5 small nuclear ribonucleoprotein 200 kDa helicase (139-148)
gugcuggccguccucaagaacgagaaacuu

SEQ ID NO: 71726 - RNA, 27 nt, Artificial Sequence
  Microtubule-actin cross-linking factor 1 (1174-1182)
gugcuggacgaggaaaucgccaaggcu

SEQ ID NO: 71727 - RNA, 27 nt, Artificial Sequence
  E3 ubiquitin-protein ligase RNF123 (218-226)
gugcuggacggcgccgucaugauguac

SEQ ID NO: 71728 - RNA, 27 nt, Artificial Sequence
  Homologous-pairing protein 2 homolog (88-97)
gugcuggacggcaagaucgucgcccuc

SEQ ID NO: 71729 - RNA, 27 nt, Artificial Sequence
  Transcription factor SOX-5 (89-97)
gugcuggacggcaaggucgccguugug

SEQ ID NO: 71730 - RNA, 27 nt, Artificial Sequence
  Serine/arginine-rich splicing factor 2 (79-87)
gugcuggacggcagagagcucaggguc

SEQ ID NO: 71731 - RNA, 27 nt, Artificial Sequence
  60S ribosomal protein L13a (8-16)
gugcuggacggcagagggcaccuccuu

SEQ ID NO: 71732 - RNA, 24 nt, Artificial Sequence
  Clustered mitochondria protein homolog (97-104)
gugcuggaccacuucagcgagcuc

SEQ ID NO: 71733 - RNA, 27 nt, Artificial Sequence
  Microtubule-associated proteins 1A/1B light chain 3B (46-54)
gugcuggacaagaccaaauuccucguc

SEQ ID NO: 71734 - RNA, 27 nt, Artificial Sequence
  Coilin (145-153)
gugcuggaccucgagcccaaggccguc

SEQ ID NO: 71735 - RNA, 27 nt, Artificial Sequence
  Protein flightless-1 homolog (107-115)
gugcuggaccucagccacaaccagcuu

SEQ ID NO: 71736 - RNA, 27 nt, Artificial Sequence
  Cadherin-2 (399-407)
gugcuggacagagagagccccaacguc

SEQ ID NO: 71737 - RNA, 27 nt, Artificial Sequence
  Receptor-type protein tyrosine phosphatase beta (1333-1341)
gugcuggacagccacauccaugccuac

SEQ ID NO: 71738 - RNA, 27 nt, Artificial Sequence
  Ubiquitin carboxyl-terminal hydrolase 19 (713-721)
gugcuggacagccucucccagucuguc

SEQ ID NO: 71739 - RNA, 27 nt, Artificial Sequence
  Biorientation of chromosomes in cell division protein 1-like 1 (1543-1551)
gugcuggacagcagaaucgagaccgcc

SEQ ID NO: 71740 - RNA, 30 nt, Artificial Sequence
  Probable tRNA methyltransferase 9-like protein (350-359)
gugcuggacagcaccgccuucaugagauac

SEQ ID NO: 71741 - RNA, 27 nt, Artificial Sequence
  Tubulin-specific chaperone A (71-79)
gugcuggacagcgucaagcucgaggcc

SEQ ID NO: 71742 - RNA, 27 nt, Artificial Sequence
  COP9 signalosome complex subunit 7b (34-42)
gugcuggaggcccccggcgucuacguu

SEQ ID NO: 71743 - RNA, 27 nt, Artificial Sequence
  Ras GTPase-activating-like protein IQGAP3 (1063-1071)
gugcuggaggacaagguccucagcguu

SEQ ID NO: 71744 - RNA, 24 nt, Artificial Sequence
  Melanoma-associated antigen 4 (287-294)
gugcuggagcacgucguuagagug

SEQ ID NO: 71745 - RNA, 27 nt, Artificial Sequence
  Leucine-tRNA ligase, cytoplasmic (271-279)
gugcuggagcccuacccuagcaagcuc

SEQ ID NO: 71746 - RNA, 27 nt, Artificial Sequence
  E3 ubiquitin-protein ligase RNF123 (425-433)
gugcuguucgacguccucagaagcguu

SEQ ID NO: 71747 - RNA, 30 nt, Artificial Sequence
  Nucleolar protein 56 (6-15)
gugcuguucgagcacgccgucggcuacgcu

SEQ ID NO: 71748 - RNA, 27 nt, Artificial Sequence
  NADH dehydrogenase (ubiquinone) iron-sulfur protein 2, mitochondrial (172-180)
gugcuguucggcgagaucaccagacuc

SEQ ID NO: 71749 - RNA, 36 nt, Artificial Sequence
  Heat shock 70 kDa protein 12A (519-530)
gugcuguucggccucgaccccgccgucaucaagguu

SEQ ID NO: 71750 - RNA, 18 nt, Artificial Sequence
  Maestro heat-like repeat-containing protein family member 1 (158-163)
gugcuguuccaccagugg

SEQ ID NO: 71751 - RNA, 27 nt, Artificial Sequence
  Exostosin-like 1 (657-665)
gugcuguucaaggaccccgucagcguu

SEQ ID NO: 71752 - RNA, 30 nt, Artificial Sequence
  Histone-lysine N-methyltransferase 2D (4817-4826)
gugcuguuccccgagagcccugccagagcu

SEQ ID NO: 71753 - RNA, 27 nt, Artificial Sequence
  Ribosomal protein S6 kinase alpha-3 (517-525)
gugcuguucaccaucacaaagacuguc

SEQ ID NO: 71754 - RNA, 30 nt, Artificial Sequence
  TAF6-like RNA polymerase II p300/CBP-associated factor-associated factor 65 kDa subunit 6L (168-177)
gugcugggcgacgauccccagcucaugaag

SEQ ID NO: 71755 - RNA, 33 nt, Artificial Sequence
  TAF6-like RNA polymerase II p300/CBP-associated factor-associated factor 65 kDa subunit 6L (168-178)
gugcugggcgacgauccccagcucaugaagguc

SEQ ID NO: 71756 - RNA, 24 nt, Artificial Sequence
  Kelch-like protein 21 (509-516)
gugcugggcgggaagcucuacguc

SEQ ID NO: 71757 - RNA, 24 nt, Artificial Sequence
  Lipopolysaccharide-responsive and beige-like anchor protein (137-144)
gugcugggcaagaucgagaaaguc

SEQ ID NO: 71758 - RNA, 24 nt, Artificial Sequence
  EH domain-containing protein 4 (483-490)
gugcugggcaagaucuggaaacuc

SEQ ID NO: 71759 - RNA, 24 nt, Artificial Sequence
  Dynactin subunit 2 (288-295)
gugcugggcaaggucaacgagauc

SEQ ID NO: 71760 - RNA, 27 nt, Artificial Sequence
  Nuclear autoantigenic sperm protein (105-113)
gugcugggcaacgcccucgaggggguc

SEQ ID NO: 71761 - RNA, 27 nt, Artificial Sequence
  Hepatoma-derived growth factor-related protein 2 (550-558)
gugcugggccccaagaucgaggccguc

SEQ ID NO: 71762 - RNA, 27 nt, Artificial Sequence
  Zinc finger protein 518A (419-427)
gugcugggccccacccucaagaacguc

SEQ ID NO: 71763 - RNA, 27 nt, Artificial Sequence
  EAW51983.1 (1173-1181)
gugcugggccccaccccugagcucguc

SEQ ID NO: 71764 - RNA, 27 nt, Artificial Sequence
  Transferrin receptor protein 1 (488-496)
gugcugggcaccagcaacuucaagguc

SEQ ID NO: 71765 - RNA, 24 nt, Artificial Sequence
  HEAT repeat-containing protein 1 (1554-1561)
gugcugggcuacaucagcgccguc

SEQ ID NO: 71766 - RNA, 30 nt, Artificial Sequence
  Integrin-linked protein kinase (219-228)
gugcugcacgagggcaccaacuucgucguu

SEQ ID NO: 71767 - RNA, 27 nt, Artificial Sequence
  Dolichyl-diphosphooligosaccharide-proteinosyltransferase subunit 1 (138-146)
gugcugcaccccuacccuacccagauc

SEQ ID NO: 71768 - RNA, 27 nt, Artificial Sequence
  Ral GTPase-activating protein subunit beta (21-29)
gugcugcacagcuaccccgaguccguc

SEQ ID NO: 71769 - RNA, 27 nt, Artificial Sequence
  Alpha-parvin (100-108)
gugcugaucgacuggauuaacgauguc

SEQ ID NO: 71770 - RNA, 27 nt, Artificial Sequence
  Leucine-tRNA ligase, cytoplasmic (203-211)
gugcugauccacagcucccaguaccuc

SEQ ID NO: 71771 - RNA, 27 nt, Artificial Sequence
  Hemicentin-1 (1559-1567)
gugcugaucaacagccucauuaagcuu

SEQ ID NO: 71772 - RNA, 27 nt, Artificial Sequence
  Neuron navigator 2 (119-127)
gugcugcucgcccagaucauucaaguc

SEQ ID NO: 71773 - RNA, 27 nt, Artificial Sequence
  Protein MON2 homolog (1145-1153)
gugcugcucgaccacauccagagcgcc

SEQ ID NO: 71774 - RNA, 33 nt, Artificial Sequence
  Ankyrin-2 (527-537)
gugcugcucgaggccggcgcugcacacagccuu

SEQ ID NO: 71775 - RNA, 27 nt, Artificial Sequence
  Protein wntless homolog (264-272)
gugcugcucgagaaggucaucuucgcc

SEQ ID NO: 71776 - RNA, 36 nt, Artificial Sequence
  Tumor necrosis factor receptor superfamily member 19 (5-16)
gugcugcucgagcaggaaaagaccuucuuuacacuu

SEQ ID NO: 71777 - RNA, 27 nt, Artificial Sequence
  Hemicentin-1 (3258-3266)
gugcugcucggcgagaacgucgaacuu

SEQ ID NO: 71778 - RNA, 30 nt, Artificial Sequence; identical to SEQ ID NO: 47551
  Nucleolar protein 56 (91-100)

SEQ ID NO: 71779 - RNA, 27 nt, Artificial Sequence
  Receptor tyrosine-protein kinase erbB-3 (840-848)
gugcugcucaagagccccucccagguc

SEQ ID NO: 71780 - RNA, 33 nt, Artificial Sequence
  A-kinase anchor protein 6 (1028-1038)
gugcugcuccccaacgaccuucuggagaagguc

SEQ ID NO: 71781 - RNA, 27 nt, Artificial Sequence
  Lysosomal-trafficking regulator (260-268)
gugcugcucagccuucuggagaagguc

SEQ ID NO: 71782 - RNA, 27 nt, Artificial Sequence
  Cyclic AMP-dependent transcription factor ATF-6 alpha (233-241)
gugcugcucagccagcccaccgucguu

SEQ ID NO: 71783 - RNA, 27 nt, Artificial Sequence
  Regulatory-associated protein of mTOR (223-231)
gugcugcucagccagguccacagacuu

SEQ ID NO: 71784 - RNA, 33 nt, Artificial Sequence
  Synaptic vesicle membrane protein VAT-1 homolog (379-389)
gugcugcucguccccggcccugagaaggaaaac

SEQ ID NO: 71785 - RNA, 33 nt, Artificial Sequence
  Serine/threonine-protein phosphatase 6 regulatory ankyrin repeat subunit A (378-388)
gugcugauggagaccagcggcacagacaugcuc

SEQ ID NO: 71786 - RNA, 27 nt, Artificial Sequence
  HEAT repeat-containing protein 1 (847-855)
gugcugaugaagcucuucaucaaaguc

SEQ ID NO: 71787 - RNA, 27 nt, Artificial Sequence
  Urocortin-2 (11-19)
gugcugaugcucggcagaguccuuguu

SEQ ID NO: 71788 - RNA, 27 nt, Artificial Sequence
  Structural maintenance of chromosomes protein 2 (153-161)
gugcugaacaugaagcccccugagauc

SEQ ID NO: 71789 - RNA, 27 nt, Artificial Sequence
  Bifunctional 3'-phosphoadenosine 5'-phosphosulfate synthase 1 (479-487)
gugcugaaccccgagaccacagucguu

SEQ ID NO: 71790 - RNA, 27 nt, Artificial Sequence
  Receptor activity-modifying protein 2 (34-42)
gugcugaacccccacgaggcccucgcu

SEQ ID NO: 71791 - RNA, 27 nt, Artificial Sequence
  Probable cytosolic iron-sulfur protein assembly protein CIAO1 (145-153)
gugcugaacagccacacccaggacguc

SEQ ID NO: 71792 - RNA, 27 nt, Artificial Sequence
  Nucleosome-remodeling factor subunit BPTF (2314-2322)
gugcugcccggcccugggcagcaacuc

SEQ ID NO: 71793 - RNA, 27 nt, Artificial Sequence
  Transmembrane protein 94 (322-330)
gugcugcccauccucccucuucuguuc

SEQ ID NO: 71794 - RNA, 21 nt, Artificial Sequence
  40S ribosomal protein S26 (63-69)
gugcugcccaagcucuacguc

SEQ ID NO: 71795 - RNA, 33 nt, Artificial Sequence
  Protocadherin Fat 3 (2698-2708)
gugcugcccccugagaccuuccucccaagcuuu

SEQ ID NO: 71796 - RNA, 27 nt, Artificial Sequence
  Oxysterol-binding protein-related protein 10 (353-361)
gugcugcccaccuucauccucgagaag

SEQ ID NO: 71797 - RNA, 27 nt, Artificial Sequence
  Oxysterol-binding protein-related protein 9 (402-410)
gugcugcccaccuucauccucgagaga

SEQ ID NO: 71798 - RNA, 30 nt, Artificial Sequence; identical to SEQ ID NO: 47571
  Protein-associating with the carboxyl-terminal domain of ezrin (30-39)

SEQ ID NO: 71799 - RNA, 27 nt, Artificial Sequence
  Zinc finger MYM-type protein 4 (793-801)
gugcugcagggcgccguccccaccguu

SEQ ID NO: 71800 - RNA, 30 nt, Artificial Sequence
  Serum paraoxonase/arylesterase 2 (326-335)
gugcugcagggcagcuccgucgccucuguu

SEQ ID NO: 71801 - RNA, 30 nt, Artificial Sequence
  Microspherule protein 1 (219-228)
gugcugcagaccaacgaccucacaagcguc

SEQ ID NO: 71802 - RNA, 42 nt, Artificial Sequence
  Heat shock 70 kDa protein 1-like (171-184)
gugcugagaaucauuaacgagcccaccgccgcugcaauagcc

SEQ ID NO: 71803 - RNA, 27 nt, Artificial Sequence
  Probable helicase with zinc finger domain (252-260)
gugcugagcgagugcaucgaaggcguc

SEQ ID NO: 71804 - RNA, 27 nt, Artificial Sequence
  Magnesium transporter protein 1 (68-76)
gugcugagcgagaaggucucccagcuc

SEQ ID NO: 71805 - RNA, 30 nt, Artificial Sequence
  Protein misato homolog 1 (109-118)
gugcugagcuccgacggcgucuggagaguu

SEQ ID NO: 71806 - RNA, 24 nt, Artificial Sequence
  Small integral membrane protein 15 (39-46)
gugcugagcuggaagcucgccaaa

SEQ ID NO: 71807 - RNA, 27 nt, Artificial Sequence
  Autophagy-related protein 16-1 (517-525)
gugcugaccggcaaggucgagaaaguu

SEQ ID NO: 71808 - RNA, 27 nt, Artificial Sequence
  Transmembraneoprotein NMB (81-89)
gugcugaccagcgacucccccgcccuc

SEQ ID NO: 71809 - RNA, 27 nt, Artificial Sequence
  E3 ubiquitin-protein ligase XIAP (409-417)
gugcuggucgccgaccucguuaacgcu

SEQ ID NO: 71810 - RNA, 27 nt, Artificial Sequence
  Eukaryotic translation initiation factor 3 subunit E (318-326)
gugcuggucaacgacuucuuucucguu

SEQ ID NO: 71811 - RNA, 27 nt, Artificial Sequence
  Hemicentin-1 (2884-2892)
gugcuggucaacaagagcgcccucauc

SEQ ID NO: 71812 - RNA, 30 nt, Artificial Sequence
  Cadherin EGF LAG seven-pass G-type receptor 2 (1100-1109)
gugcuggucagcgacggcguucacuccgug

SEQ ID NO: 71813 - RNA, 30 nt, Artificial Sequence
  Protocadherin beta-8 (440-449)
gugcuggucagcgacguuaacgauaaugcc

SEQ ID NO: 71814 - RNA, 27 nt, Artificial Sequence
  Elongator complex protein 2 (41-49)
gugcuguacgacccccucaagagaguc

SEQ ID NO: 71815 - RNA, 33 nt, Artificial Sequence
  Maltase-glucoamylase (708-718)
gugcuguacgagggcgucgacgaaguuaaggcc

SEQ ID NO: 71816 - RNA, 30 nt, Artificial Sequence
  Slit homolog 3 protein (361-370)
gugcuguacggcaacaagaucaccgagauu

SEQ ID NO: 71817 - RNA, 30 nt, Artificial Sequence; identical to SEQ ID NO: 47590
  Slit homolog 2 protein (354-363)

SEQ ID NO: 71818 - RNA, 27 nt, Artificial Sequence
  Protein nepro homolog (10-18)
gugcuguacaagggcguccucaaaaga

SEQ ID NO: 71819 - RNA, 36 nt, Artificial Sequence
  Melanocyte protein PMEL (483-494)
gugcuguacagauauggcagcuucuccgucacccuc

SEQ ID NO: 71820 - RNA, 27 nt, Artificial Sequence
  Putative eukaryotic translation initiation factor 2 subunit 3-like protein (151-159)
gugauggacgccgcucugcuccuuauc

SEQ ID NO: 71821 - RNA, 30 nt, Artificial Sequence
  Putative eukaryotic translation initiation factor 2 subunit 3-like protein (151-160)
gugauggacgccgcucugcuccuuaucgca

SEQ ID NO: 71822 - RNA, 27 nt, Artificial Sequence
  Carboxypeptidase Q (442-450)
gugauggaccccaagcagaugaacguc

SEQ ID NO: 71823 - RNA, 33 nt, Artificial Sequence
  Lipopolysaccharide-responsive and beige-like anchor protein (1389-1399)
gugauguucaacuuucccgacccugccaccguc

SEQ ID NO: 71824 - RNA, 54 nt, Artificial Sequence
  Cytochrome c oxidase subunit 6C (58-75)
gugaugaaggacuucgaggaaaugagaaaagccggcaucuuucagagcgucaag

SEQ ID NO: 71825 - RNA, 30 nt, Artificial Sequence; identical to SEQ ID NO: 47598
  Scavenger receptor class B member 1 (146-155)

SEQ ID NO: 71826 - RNA, 27 nt, Artificial Sequence
  Xylosyltransferase 1 (587-595)
gugaugcccaagaaagucuucaagauc

SEQ ID NO: 71827 - RNA, 42 nt, Artificial Sequence
  78 kDa glucose-regulated protein (177-190)
gugaugagaaucauuaacgagcccaccgccgcugcaauagcc

SEQ ID NO: 71828 - RNA, 45 nt, Artificial Sequence
  78 kDa glucose-regulated protein (177-191)
gugaugagaaucauuaacgagcccaccgccgcugcaauagccuac

SEQ ID NO: 71829 - RNA, 27 nt, Artificial Sequence
  Non-structural maintenance of chromosomes element 1 homolog (4-12)
gugaugaccgacguccacagaagguuc

SEQ ID NO: 71830 - RNA, 33 nt, Artificial Sequence
  DNA (cytosine-5)-methyltransferase 3A (139-149)
gugaugugguucggcgacgggaaguuuagcguc

SEQ ID NO: 71831 - RNA, 21 nt, Artificial Sequence
  Interferon-induced protein with tetratricopeptide repeats 1 (396-402)
gugaacgccaucauucacuac

SEQ ID NO: 71832 - RNA, 54 nt, Artificial Sequence
  Beta-2-microglobulin (81-98)
gugaaccacgucacccugagccagcccaagaucguuaaaugggacagagauaug

SEQ ID NO: 71833 - RNA, 42 nt, Artificial Sequence
  Protocadherin gamma-C3 (553-566)
gugaacaucuucgucaccgacagaaaugauaacgccccccag

SEQ ID NO: 71834 - RNA, 27 nt, Artificial Sequence
  T-complex protein 1 subunit eta (46-54)
gugaacaagaucaaagagauugccguc

SEQ ID NO: 71835 - RNA, 33 nt, Artificial Sequence
  Cytochrome c oxidase subunit 6A1, mitochondrial (76-86)
gugaacccccugccuaccggcuacgaggacgaa

SEQ ID NO: 71836 - RNA, 33 nt, Artificial Sequence
  Pumilio homolog 1 (533-543)
gugaacagcgcccuggcuuucggccaggggcuc

SEQ ID NO: 71837 - RNA, 21 nt, Artificial Sequence
  T-complex protein 1 subunit zeta-2 (199-205)
gugaacagcggcuucuuuuac

SEQ ID NO: 71838 - RNA, 21 nt, Artificial Sequence
  Bifunctional glutamate/proline-tRNA ligase (51-57)
gugaacagcauccugagauac

SEQ ID NO: 71839 - RNA, 72 nt, Artificial Sequence
  Ras GTPase-activating-like protein IQGAP1 (303-326)
gugaacaccuucagcgcccuggcuaauaucgaccucgcacuugagcagggcgaugcccuggcguuguuuaga

SEQ ID NO: 71840 - RNA, 27 nt, Artificial Sequence
  40S ribosomal protein S30 (117-125)
gugaacgucguucccaccuucggcaag

SEQ ID NO: 71841 - RNA, 30 nt, Artificial Sequence
  Transmembraneoprotein NMB (485-494)
gugcccgacagagauccugccagcccacug

SEQ ID NO: 71842 - RNA, 27 nt, Artificial Sequence
  Endothelin B receptor (266-274)
gugcccuucauccagaaggccagcguc

SEQ ID NO: 71843 - RNA, 27 nt, Artificial Sequence
  Nectin-3 (335-343)
gugcccuucaagcagaccagcuccauc

SEQ ID NO: 71844 - RNA, 24 nt, Artificial Sequence
  Heat shock protein 105 kDa (412-419)
gugcccuucccuaucagccugauu

SEQ ID NO: 71845 - RNA, 33 nt, Artificial Sequence
  Elastin (436-446)
gugcccggcgccccuggggcugucccaggaguu

SEQ ID NO: 71846 - RNA, 51 nt, Artificial Sequence
  Carboxypeptidase D (836-852)
gugcccggcaccuacaagaucacagccagcgcuagaggguauaacccuguc

SEQ ID NO: 71847 - RNA, 45 nt, Artificial Sequence
  Transmembraneoprotein NMB (221-235)
gugcccaucgcccaggucaaggacguuuacgugguaaccgaucaa

SEQ ID NO: 71848 - RNA, 78 nt, Artificial Sequence
  Transmembraneoprotein NMB (221-246)
gugcccaucgcccaggucaaggacguuuacgugguaaccgaucaaauuccuguguucgucacaauguuucagaaaaac

SEQ ID NO: 71849 - RNA, 36 nt, Artificial Sequence
  Neuronal cell adhesion molecule (399-410)
gugcccaucgagauugccccugacgauccaagcaga

SEQ ID NO: 71850 - RNA, 39 nt, Artificial Sequence
  Neuronal cell adhesion molecule (399-411)
gugcccaucgagauugccccugacgauccaagcagaaag

SEQ ID NO: 71851 - RNA, 48 nt, Artificial Sequence
  Neuronal cell adhesion molecule (399-414)
gugcccaucgagauugccccugacgauccaagcagaaagauagacggc

SEQ ID NO: 71852 - RNA, 27 nt, Artificial Sequence
  pre-rRNA processing protein FTSJ3 (78-86)
gugcccaucaagccucugccaaacguc

SEQ ID NO: 71853 - RNA, 42 nt, Artificial Sequence
  Thioredoxin reductase 1, cytoplasmic (252-265)
gugcccaucaaggucgagcagauugaagccggcaccccuggg

SEQ ID NO: 71854 - RNA, 27 nt, Artificial Sequence
  Endoglin (526-534)
gugcccaucccuaagaccggcacacug

SEQ ID NO: 71855 - RNA, 27 nt, Artificial Sequence
  Interferon-induced 35 kDa protein (73-81)
gugcccaagagccuggucuccaaccuc

SEQ ID NO: 71856 - RNA, 42 nt, Artificial Sequence
  Solute carrier family 2, facilitated glucose transporter member 14 (177-190)
gugcccauguacaucggcgagauuagcccuaccgcccugaga

SEQ ID NO: 71857 - RNA, 45 nt, Artificial Sequence
  Solute carrier family 2, facilitated glucose transporter member 1 (140-154)
gugcccauguacgucggcgagguuagcccuaccgcccugagaggg

SEQ ID NO: 71858 - RNA, 27 nt, Artificial Sequence
  Nucleosome-remodeling factor subunit BPTF (238-246)
gugcccaacgagcacaucaugaauguc

SEQ ID NO: 71859 - RNA, 30 nt, Artificial Sequence
  COMM domain-containing protein 7 (78-87)
gugcccaacggcgcccugaagaaaagccuc

SEQ ID NO: 71860 - RNA, 27 nt, Artificial Sequence
  Diacylglycerol O-acyltransferase 1 (328-336)
gugcccaaccaccugaucuggcucauu

SEQ ID NO: 71861 - RNA, 27 nt, Artificial Sequence
  Selenoprotein N (214-222)
gugcccaaccacagaagccugaauguc

SEQ ID NO: 71862 - RNA, 24 nt, Artificial Sequence
  Polymerase I and transcript release factor (228-235)
gugcccccuuucaccuuucacguc

SEQ ID NO: 71863 - RNA, 24 nt, Artificial Sequence
  Sodium/potassium-transporting ATPase subunit alpha-3 (168-175)
gugccccagcaagcccuggucauc

SEQ ID NO: 71864 - RNA, 27 nt, Artificial Sequence
  Neurofibromin (199-207)
gugccccagagccacaugccugagauc

SEQ ID NO: 71865 - RNA, 27 nt, Artificial Sequence
  Krueppel-like factor 15 (133-141)
gugcccagaccuuuccagccaacccug

SEQ ID NO: 71866 - RNA, 24 nt, Artificial Sequence
  Transmembrane emp24 domain-containing protein 7 (5-12)
gugcccagaagcgccuccguccug

SEQ ID NO: 71867 - RNA, 27 nt, Artificial Sequence
  Transmembrane emp24 domain-containing protein 7 (5-13)
gugcccagaagcgccuccguccugcuc

SEQ ID NO: 71868 - RNA, 30 nt, Artificial Sequence
  Transmembrane emp24 domain-containing protein 7 (5-14)
gugcccagaagcgccuccguccugcuccuu

SEQ ID NO: 71869 - RNA, 27 nt, Artificial Sequence
  F-box/WD repeat-containing protein 9 (435-443)
gugcccaccgacccuccaagaacaauc

SEQ ID NO: 71870 - RNA, 24 nt, Artificial Sequence
  Protein Smaug homolog 1 (103-110)
gugcccaccacaaucaacacuauu

SEQ ID NO: 71871 - RNA, 27 nt, Artificial Sequence
  Major facilitator superfamily domain-containing protein 12 (214-222)
gugcccgucuucagaaaccugagccuc

SEQ ID NO: 71872 - RNA, 27 nt, Artificial Sequence
  Mitogen-activated protein kinase 7 (125-133)
gugcccuacggcgaguucaagagcguc

SEQ ID NO: 71873 - RNA, 24 nt, Artificial Sequence
  Solute carrier family 22 member 18 (47-54)
gugcccuaccugagcagaaagcuc

SEQ ID NO: 71874 - RNA, 24 nt, Artificial Sequence
  Glycogen debranching enzyme (1050-1057)
gugcccuacagacugaacgagauc

SEQ ID NO: 71875 - RNA, 27 nt, Artificial Sequence
  Phosphatidylinositol 3-kinase catalytic subunit type 3 (400-408)
gugcaggcccugaaguacgagaacuuc

SEQ ID NO: 71876 - RNA, 27 nt, Artificial Sequence
  Adipocyte enhancer-binding protein 1 (657-665)
gugcaggacaccagaauccaccugguc

SEQ ID NO: 71877 - RNA, 27 nt, Artificial Sequence
  Spectrin beta chain, non-erythrocytic 5 (994-1002)
gugcagcuggcccacagcgucgagguu

SEQ ID NO: 71878 - RNA, 27 nt, Artificial Sequence
  Mitochondrial pyruvate carrier 1 (19-27)
gugcagcccagaaacuggcugcucuuc

SEQ ID NO: 71879 - RNA, 27 nt, Artificial Sequence
  Mitogen-activated protein kinase kinase kinase 6 (125-133)
gugcagcccagccuguucuaccaccuc

SEQ ID NO: 71880 - RNA, 24 nt, Artificial Sequence
  CD99 antigen (178-185)
gugcagagaacccugcucgagaag

SEQ ID NO: 71881 - RNA, 27 nt, Artificial Sequence
  eIF-2-alpha kinase activator GCN1 (1752-1760)
gugagagacggcuacaucaugauguuc

SEQ ID NO: 71882 - RNA, 27 nt, Artificial Sequence
  Lysosomal-trafficking regulator (3248-3256)
gugagaaugcccccuuucaccaagaug

SEQ ID NO: 71883 - RNA, 27 nt, Artificial Sequence
  Tripeptidyl-peptidase 1 (151-159)
gugagaagcccccacccuuaccagcug

SEQ ID NO: 71884 - RNA, 24 nt, Artificial Sequence
  Anion exchange protein (986-993)
gugagcgccgcugcagucguuuuc

SEQ ID NO: 71885 - RNA, 24 nt, Artificial Sequence
  V-type proton ATPase subunit H (400-407)
gugagcgacgauccccagguccug

SEQ ID NO: 71886 - RNA, 24 nt, Artificial Sequence
  Cofilin-1 (7-14)
gugagcgacggcgucaucaagguu

SEQ ID NO: 71887 - RNA, 27 nt, Artificial Sequence
  Cofilin-1 (7-15)
gugagcgacggcgucaucaagguuuuc

SEQ ID NO: 71888 - RNA, 24 nt, Artificial Sequence
  HLA class I histocompatibility antigen, Cw-3 alpha chain (218-225)
gugagcgaccacgaggccacccug

SEQ ID NO: 71889 - RNA, 24 nt, Artificial Sequence
  Proteasome subunit beta type-8 (264-271)
gugagcgaccugcuccaccaguac

SEQ ID NO: 71890 - RNA, 27 nt, Artificial Sequence
  Baculoviral IAP repeat-containing protein 6 (689-697)
gugagcgaccccaaccugauccacguc

SEQ ID NO: 71891 - RNA, 39 nt, Artificial Sequence
  Microtubule-associated protein (1369-1381)
gugagcgaggaaaacaagaccgacgccgcuaauagauac

SEQ ID NO: 71892 - RNA, 24 nt, Artificial Sequence
  Neuroblast differentiation-associated protein AHNAK (3336-3343)
gugagcggccccaagcugaacauc

SEQ ID NO: 71893 - RNA, 42 nt, Artificial Sequence
  PR domain zinc finger protein 10 (909-922)
gugagcggccagccccuguccccuucugcccaacaggcucag

SEQ ID NO: 71894 - RNA, 30 nt, Artificial Sequence
  Melanocyte protein PMEL (412-421)
gugagcaucgucguucuguccggcaccaca

SEQ ID NO: 71895 - RNA, 27 nt, Artificial Sequence
  Kinesin-like protein KIF27 (522-530)
gugagccugaaggaggcccagaaaguc

SEQ ID NO: 71896 - RNA, 24 nt, Artificial Sequence
  HLA class I histocompatibility antigen, A-23 alpha chain (358-365)
gugagccugaccgccugcaagguc

SEQ ID NO: 71897 - RNA, 27 nt, Artificial Sequence
  Potassium-transporting ATPase alpha chain 1 (600-608)
gugagcaugaucgaccccccuagagcc

SEQ ID NO: 71898 - RNA, 27 nt, Artificial Sequence
  Cyclic AMP-dependent transcription factor ATF-6 alpha (445-453)
gugagcaacgacaaggcccugaugguc

SEQ ID NO: 71899 - RNA, 27 nt, Artificial Sequence
  Vacuolar protein sorting-associated protein 13D (2458-2466)
gugagcaacgagagacaccuggaaguc

SEQ ID NO: 71900 - RNA, 27 nt, Artificial Sequence
  Transcription initiation factor TFIID subunit 1 (307-315)
gugagccagaagucccuguggaacuac

SEQ ID NO: 71901 - RNA, 27 nt, Artificial Sequence
  Neuron navigator 3 (198-206)
gugagcuccaagaccacacugcaguac

SEQ ID NO: 71902 - RNA, 27 nt, Artificial Sequence
  Dolichyl-diphosphooligosaccharide-proteinosyltransferase subunit 1 (300-308)
gugagcaccucccaccugcucauccuu

SEQ ID NO: 71903 - RNA, 27 nt, Artificial Sequence
  DNA damage-binding protein 1 (7-15)
gugaccgcccagaagcccacagcuguc

SEQ ID NO: 71904 - RNA, 27 nt, Artificial Sequence
  General transcription factor II-I (201-209)
gugaccgacgccgauagaagcauccug

SEQ ID NO: 71905 - RNA, 69 nt, Artificial Sequence
  Nebulin (5596-5618)
gugaccgacgauaagaacacaguccuggcccucagaaauacucuuaucgagagcgaccugaaauacaag

SEQ ID NO: 71906 - RNA, 27 nt, Artificial Sequence
  HLA class II histocompatibility antigen, DQ beta 1 chain (114-122)
gugaccgacuucuaccccgcccagauc

SEQ ID NO: 71907 - RNA, 27 nt, Artificial Sequence
  Protein dopey-2 (2274-2282)
gugaccgacagccccagaauccugaag

SEQ ID NO: 71908 - RNA, 27 nt, Artificial Sequence
  Williams-Beuren syndrome chromosomal region 16 protein (318-326)
gugaccgacagcacacaggucaacguu

SEQ ID NO: 71909 - RNA, 30 nt, Artificial Sequence
  Nebulin (5327-5336)
gugaccgacacagucagcgauguuaaguac

SEQ ID NO: 71910 - RNA, 51 nt, Artificial Sequence
  Cytochrome c oxidase subunit 6B1 (1-17)
gugaccgacugggaugagcagagagccgaaggcacauuccccgggaagauc

SEQ ID NO: 71911 - RNA, 27 nt, Artificial Sequence
  Insulin-like growth factor 1 receptor (683-691)
gugaccgagaaccccaagacagaaguc

SEQ ID NO: 71912 - RNA, 27 nt, Artificial Sequence
  Ras association domain-containing protein 3 (64-72)
gugaccgagagccccgccaaguucgcu

SEQ ID NO: 71913 - RNA, 30 nt, Artificial Sequence; identical to SEQ ID NO: 47686
  Large neutral amino acids transporter small subunit 2 (80-89)

SEQ ID NO: 71914 - RNA, 27 nt, Artificial Sequence
  Cadherin EGF LAG seven-pass G-type receptor 1 (634-642)
gugaccuucagcgcccugcuccccggc

SEQ ID NO: 71915 - RNA, 63 nt, Artificial Sequence
  Heterogeneous nuclear ribonucleoprotein F (327-347)
gugaccggcgaggccgacgucgaauucgcuacacacgaggaagcaguugccgcgaugagcaag

SEQ ID NO: 71916 - RNA, 36 nt, Artificial Sequence
  Mucin-19 (3971-3982)
gugaccggcaucacagggcccagcgccggaauuacu

SEQ ID NO: 71917 - RNA, 72 nt, Artificial Sequence
  Splicing factor 3B subunit 4 (49-72)
gugaccggccagcaccaaggguacggauucgucgaguuucugagcgaagaggacgccgauuaugcuaucaag

SEQ ID NO: 71918 - RNA, 27 nt, Artificial Sequence
  Melanotransferrin (119-127)
gugaccaucgacacacugaagggcguc

SEQ ID NO: 71919 - RNA, 30 nt, Artificial Sequence
  Adhesion G protein-coupled receptor F5 (269-278)
gugaccaucaacgagagcaauuucuuuguc

SEQ ID NO: 71920 - RNA, 27 nt, Artificial Sequence
  Maltase-glucoamylase (886-894)
gugaccaucacagaccugcagggccuc

SEQ ID NO: 71921 - RNA, 36 nt, Artificial Sequence
  Annexin A2 (54-65)
gugaccaucgucaacauucugacaaauagaagcaac

SEQ ID NO: 71922 - RNA, 42 nt, Artificial Sequence
  Annexin A2 (54-67)
gugaccaucgucaacauucugacaaauagaagcaacgcccag

SEQ ID NO: 71923 - RNA, 57 nt, Artificial Sequence
  Prelamin-A/C (346-364)
gugaccaucugggccgcuggcgcaggggccacacacagccccccuacugaccugguc

SEQ ID NO: 71924 - RNA, 39 nt, Artificial Sequence
  Laminin subunit gamma-1 (671-683)
gugacccuggccagcgcuagacccggcccugggguccca

SEQ ID NO: 71925 - RNA, 33 nt, Artificial Sequence
  Heat shock transcription factor, X-linked (369-379)
gugacccuggucgccgcuggcgcagcccagccc

SEQ ID NO: 71926 - RNA, 27 nt, Artificial Sequence
  Trafficking protein particle complex subunit 2-like protein (73-81)
gugaccaacagcaaggucaaauucguu

SEQ ID NO: 71927 - RNA, 27 nt, Artificial Sequence
  Solute carrier family 26 member 10 (164-172)
gugacccccgaccagcuguucgucagc

SEQ ID NO: 71928 - RNA, 30 nt, Artificial Sequence; identical to SEQ ID NO: 47701
  Treacle protein (248-257)

SEQ ID NO: 71929 - RNA, 45 nt, Artificial Sequence
  Desmoglein-2 (901-915)
gugacccaggagaucgucacagaaagaagcguuuccucuaggcaa

SEQ ID NO: 71930 - RNA, 48 nt, Artificial Sequence
  Desmoglein-2 (901-916)
gugacccaggagaucgucacagaaagaagcguuuccucuaggcaagcc

SEQ ID NO: 71931 - RNA, 48 nt, Artificial Sequence
  Voltage-dependent anion-selective channel protein 1 (164-179)
gugacccagagcaacuucgccgucggcuacaagacagacgaguuucaa

SEQ ID NO: 71932 - RNA, 27 nt, Artificial Sequence
  Bifunctional glutamate/proline-tRNA ligase (1104-1112)
gugaccagaagcggcaagacagagcug

SEQ ID NO: 71933 - RNA, 33 nt, Artificial Sequence
  HMG domain-containing protein 4 (358-368)
gugaccagcggccccccuccauccaucccguac

SEQ ID NO: 71934 - RNA, 39 nt, Artificial Sequence
  Vimentin (31-43)
gugaccacaagcacuagaacguacucccugggcucugcc

SEQ ID NO: 71935 - RNA, 27 nt, Artificial Sequence
  Low-density lipoprotein receptor-related protein 2 (584-592)
gugaccuacgacggcauccagagaaag

SEQ ID NO: 71936 - RNA, 27 nt, Artificial Sequence
  Unconventional myosin-Ic (1036-1044)
guggucgcccccagacugaacagcagg

SEQ ID NO: 71937 - RNA, 30 nt, Artificial Sequence
  Echinoderm microtubule-associated protein-like 3 (378-387)
guggucgacgauagcaacgagcacaugcug

SEQ ID NO: 71938 - RNA, 27 nt, Artificial Sequence
  Helicase with zinc finger domain 2 (2588-2596)
guggucgaccccaaccagguuaaugug

SEQ ID NO: 71939 - RNA, 27 nt, Artificial Sequence
  Catenin alpha-1 (33-41)
guggucgaggacggcauccugaagcuc

SEQ ID NO: 71940 - RNA, 42 nt, Artificial Sequence
  Beta-hexosaminidase subunit alpha (397-410)
guggucgagccccuggccuucgaaggcaccccugagcagaag

SEQ ID NO: 71941 - RNA, 39 nt, Artificial Sequence
  Glyceraldehyde-3-phosphate dehydrogenase (95-107)
guggucgagagcaccggcguuuucacaacuauggaaaag

SEQ ID NO: 71942 - RNA, 45 nt, Artificial Sequence
  Glyceraldehyde-3-phosphate dehydrogenase (95-109)
guggucgagagcaccggcguuuucacaacuauggaaaaggccggg

SEQ ID NO: 71943 - RNA, 48 nt, Artificial Sequence
  Glyceraldehyde-3-phosphate dehydrogenase (95-110)
guggucgagagcaccggcguuuucacaacuauggaaaaggccggggcu

SEQ ID NO: 71944 - RNA, 27 nt, Artificial Sequence
  Thioredoxin-interacting protein (12-20)
guggucuucaacgaccccgagaagguu

SEQ ID NO: 71945 - RNA, 27 nt, Artificial Sequence
  Ribosomal RNA-processing protein 7 homolog A (119-127)
guggucuuccagaagcccagcggcguu

SEQ ID NO: 71946 - RNA, 27 nt, Artificial Sequence
  F-box only protein 7 (293-301)
gugguccugccccucgagcuuaagcug

SEQ ID NO: 71947 - RNA, 27 nt, Artificial Sequence
  ABCB9 protein (422-430)
gugguccagguuagcauccuguacuau

SEQ ID NO: 71948 - RNA, 24 nt, Artificial Sequence
  Unconventional myosin-Ic (251-258)
guggucagaaaggcccugaccguu

SEQ ID NO: 71949 - RNA, 27 nt, Artificial Sequence
  Cancer/testis antigen 55 (63-71)
guggucaccggcaacguuccccugaag

SEQ ID NO: 71950 - RNA, 24 nt, Artificial Sequence
  Protein FAM65B (860-867)
guggucaccguuuuccaguacuau

SEQ ID NO: 71951 - RNA, 27 nt, Artificial Sequence
  Leucine-rich repeat LGI family member 4 (16-24)
guggucguugccuggagacccccuaag

SEQ ID NO: 71952 - RNA, 36 nt, Artificial Sequence
  Glutamate receptor ionotropic, kainate 2 (174-185)
guggucuacgacgauagcaccggccugaucagacuc

SEQ ID NO: 71953 - RNA, 45 nt, Artificial Sequence
  Calcium-binding mitochondrial carrier protein SCaMC-1 (444-458)
guggucuacgagaacaugaagcagacccugggcguuacacaaaaa

SEQ ID NO: 71954 - RNA, 33 nt, Artificial Sequence
  N-acetyllactosaminide beta-1,6-N-acetylglucosaminyl-transferase, isoform A (159-169)
guggucuacggcgggaucagcagacugcaggcc

SEQ ID NO: 71955 - RNA, 36 nt, Artificial Sequence
  m7GpppX diphosphatase (131-142)
guggucuaccccgccaccgagaagcaccugcagaaa

SEQ ID NO: 71956 - RNA, 27 nt, Artificial Sequence
  Melanoma-derived growth regulatory protein (69-77)
guggucuacguuuucagcaagcugaaa

SEQ ID NO: 71957 - RNA, 30 nt, Artificial Sequence
  2-hydroxyacylsphingosine 1-beta-galactosyltransferase (258-267)
guggucuacguuggcgggauccugaccaag

SEQ ID NO: 71958 - RNA, 27 nt, Artificial Sequence
  N-acylglucosamine 2-epimerase (48-56)
guguacgacgaucugaaguaugucugg

SEQ ID NO: 71959 - RNA, 30 nt, Artificial Sequence
  Cleft lip and palate transmembrane protein 1 (470-479)
guguacgacgauauggccuucagauaucug

SEQ ID NO: 71960 - RNA, 36 nt, Artificial Sequence
  Protein phosphatase 1A (58-69)
guguacgacggccacgccgggagccaggucgcuaag

SEQ ID NO: 71961 - RNA, 27 nt, Artificial Sequence
  Melanoma-associated antigen 4 (231-239)
guguacgacggcagagagcacaccguc

SEQ ID NO: 71962 - RNA, 30 nt, Artificial Sequence
  Nuclear pore complex protein Nup160 (1114-1123)
guguacgacagacccggcgccagcccuaag

SEQ ID NO: 71963 - RNA, 24 nt, Artificial Sequence
  Retinoic acid receptor alpha (49-56)
guguacgagaccgacgucuucguu

SEQ ID NO: 71964 - RNA, 27 nt, Artificial Sequence
  Origin recognition complex subunit 3 (436-444)
guguacuucagcgccgcucacgcacug

SEQ ID NO: 71965 - RNA, 27 nt, Artificial Sequence
  Melanoma-associated antigen C2 (266-274)
guguacggcgagcccagagaacugcuc

SEQ ID NO: 71966 - RNA, 27 nt, Artificial Sequence
  UBX domain-containing protein 6 (214-222)
guguacggcuucgucagagaggcccug

SEQ ID NO: 71967 - RNA, 27 nt, Artificial Sequence
  Tripartite motif-containing protein 55 (92-100)
guguacggccugcagagaaaccuccuu

SEQ ID NO: 71968 - RNA, 27 nt, Artificial Sequence
  Sulfate transporter (138-146)
guguacggccuguauaccagcuucuuu

SEQ ID NO: 71969 - RNA, 24 nt, Artificial Sequence
  Filamin-A (747-754)
guguacggccccggggucgccaag

SEQ ID NO: 71970 - RNA, 24 nt, Artificial Sequence
  Serine palmitoyltransferase 2 (238-245)
guguacggccagcccagaaccagg

SEQ ID NO: 71971 - RNA, 27 nt, Artificial Sequence
  Rho-related BTB domain-containing protein 3 (463-471)
guguacggcgucagcaaggagaccuuc

SEQ ID NO: 71972 - RNA, 27 nt, Artificial Sequence
  Beta-galactoside alpha-2,6-sialyltransferase 1 (260-268)
guguaccacagcgacauccccaagugg

SEQ ID NO: 71973 - RNA, 27 nt, Artificial Sequence
  Heterogeneous nuclear ribonucleoprotein L-like (131-139)
guguacaucgccggccagcaagcuuuc

SEQ ID NO: 71974 - RNA, 27 nt, Artificial Sequence
  Kinesin-like protein KIF3C (175-183)
guguacaucaaggaccugagcuccuuc

SEQ ID NO: 71975 - RNA, 27 nt, Artificial Sequence
  Ubiquitin carboxyl-terminal hydrolase 40 (308-316)
guguacaucaaggacgucgaucaccug

SEQ ID NO: 71976 - RNA, 24 nt, Artificial Sequence
  26S proteasome non-ATPase regulatory subunit 8 (131-138)
guguacaucaagcaccccgucagc

SEQ ID NO: 71977 - RNA, 30 nt, Artificial Sequence; identical to SEQ ID NO: 47750
  Protocadherin gamma-A11 (898-907)

SEQ ID NO: 71978 - RNA, 30 nt, Artificial Sequence
  Myotubularin (63-72)
guguacaucaccaacuauagacuguaccuc

SEQ ID NO: 71979 - RNA, 27 nt, Artificial Sequence
  Polycystic kidney disease 2-like 1 protein (265-273)
guguacaacgccaauaucaaccuguuc

SEQ ID NO: 71980 - RNA, 27 nt, Artificial Sequence
  Intron-binding protein aquarius (344-352)
guguacaacauguauaugcaccugauc

SEQ ID NO: 71981 - RNA, 27 nt, Artificial Sequence
  Unconventional myosin-X (213-221)
guguacaacaauaacagcuccagauuc

SEQ ID NO: 71982 - RNA, 27 nt, Artificial Sequence
  Exocyst complex component 6B (535-543)
guguacaaccagaucaaggaguucauu

SEQ ID NO: 71983 - RNA, 27 nt, Artificial Sequence
  HLA class II histocompatibility antigen, DR beta 5 chain (96-104)
guguaccccgccagaacccagacacug

SEQ ID NO: 71984 - RNA, 27 nt, Artificial Sequence
  HLA class II histocompatibility antigen, DO beta chain (127-135)
guguaccccgagagaaccccucugcuc

SEQ ID NO: 71985 - RNA, 27 nt, Artificial Sequence
  tRNA-splicing endonuclease subunit Sen34 (246-254)
guguaccccggcgacccucugagauuc

SEQ ID NO: 71986 - RNA, 27 nt, Artificial Sequence
  Cullin-associated NEDD8-dissociated protein 1 (651-659)
guguaccccagcucccugucuaagauc

SEQ ID NO: 71987 - RNA, 30 nt, Artificial Sequence
  Zinc finger protein 529 (226-235)
guguaccagaagauccacaacgagaaauuc

SEQ ID NO: 71988 - RNA, 27 nt, Artificial Sequence
  DNA-directed RNA polymerase I subunit RPA1 (1314-1322)
guguaccagcugagauuccaauuucuc

SEQ ID NO: 71989 - RNA, 27 nt, Artificial Sequence
  Protein CDV3 homolog (66-74)
guguacagacccccuggcgccaggcug

SEQ ID NO: 71990 - RNA, 27 nt, Artificial Sequence
  Polynucleotide 5'-hydroxyl-kinase NOL9 (499-507)
guguacaccgacuucgccuuuagaauc

SEQ ID NO: 71991 - RNA, 27 nt, Artificial Sequence
  HEAT repeat-containing protein 5A (1098-1106)
guguacaccgacagauuccaccugauc

SEQ ID NO: 71992 - RNA, 27 nt, Artificial Sequence
  Ral GTPase-activating protein subunit beta (89-97)
guguacaccgacuggaucauggcccug

SEQ ID NO: 71993 - RNA, 27 nt, Artificial Sequence
  Kidney mitochondrial carrier protein 1 (125-133)
guguacacccacuuccugagcuccuuu

SEQ ID NO: 71994 - RNA, 27 nt, Artificial Sequence
  Uncharacterized protein C18orf8 (400-408)
guguacacccacguccugagcgccuuc

SEQ ID NO: 71995 - RNA, 27 nt, Artificial Sequence
  Sprouty-related, EVH1 domain-containing protein 2 (80-88)
guguacaccaaggccaaccccacauuc

SEQ ID NO: 71996 - RNA, 27 nt, Artificial Sequence
  2'-5'-oligoadenylate synthase 3 (909-917)
guguacgucgaccugauccacagcuau

SEQ ID NO: 71997 - RNA, 24 nt, Artificial Sequence
  Melanoma-derived growth regulatory protein (70-77)
guguacgucuucagcaagcugaaa

SEQ ID NO: 71998 - RNA, 30 nt, Artificial Sequence
  Long-chain fatty acid transport protein 1 (34-43)
guguacgucggcagcgggggauggagauuc

SEQ ID NO: 71999 - RNA, 27 nt, Artificial Sequence
  Hemicentin-1 (4343-4351)
guguacgucaaggagcccccuguuuuc

SEQ ID NO: 72000 - RNA, 27 nt, Artificial Sequence
  AP-3 complex subunit mu-2 (274-282)
guguacgucaagcacaacaucagcuuc

SEQ ID NO: 72001 - RNA, 30 nt, Artificial Sequence
  Large neutral amino acids transporter small subunit 1 (22-31)
guguacguccugaccaaccucgccuauuuc

SEQ ID NO: 72002 - RNA, 24 nt, Artificial Sequence
  Histone H2B type 2-F (40-47)
guguacgucuauaagguucugaaa

SEQ ID NO: 72003 - RNA, 27 nt, Artificial Sequence
  Leptin receptor gene-related protein (27-35)
guguacuggccccuguucguccucauc

SEQ ID NO: 72004 - RNA, 27 nt, Artificial Sequence
  GDP-fucose protein O-fucosyltransferase 1 (6-14)
ugggccagaccccugagcguguccuuc

SEQ ID NO: 72005 - RNA, 66 nt, Artificial Sequence
  Modulator of apoptosis 1 (9-30)
uggugcagaggcauggacaugaaccccaggaaggcccugcucaucgcugggauuagccaguccugu

SEQ ID NO: 72006 - RNA, 36 nt, Artificial Sequence
  Puromycin-sensitive aminopeptidase (479-490)
ugggagagccuggaaaacgccuccggcaagcccauc

SEQ ID NO: 72007 - RNA, 42 nt, Artificial Sequence
  Protein CREG1 (68-81)
uggggcgcccuggcuaccaucagcacacucgaggcagugaga

SEQ ID NO: 72008 - RNA, 45 nt, Artificial Sequence
  Protein CREG1 (68-82)
uggggcgcccuggcuaccaucagcacacucgaggcagugagaggg

SEQ ID NO: 72009 - RNA, 18 nt, Artificial Sequence
  Dedicator of cytokinesis protein 9 (121-126)
uggcaccuggugaacuac

SEQ ID NO: 72010 - RNA, 18 nt, Artificial Sequence
  Dedicator of cytokinesis protein 10 (114-119)
uggcacguggucaacuac

SEQ ID NO: 72011 - RNA, 18 nt, Artificial Sequence
  Forkhead box protein N2 (51-56)
uggauccuggaccacuuc

SEQ ID NO: 72012 - RNA, 27 nt, Artificial Sequence
  Neutral amino acid transporter A (155-163)
uggaucguggacagaaccacaacuguc

SEQ ID NO: 72013 - RNA, 27 nt, Artificial Sequence
  Bifunctional glutamate/proline-tRNA ligase (616-624)
uggcuggccgagaccacacacgcucuc

SEQ ID NO: 72014 - RNA, 30 nt, Artificial Sequence
  60S ribosomal protein L19 (4-13)
uggcuggaccccaacgagaccaaugaaauc

SEQ ID NO: 72015 - RNA, 30 nt, Artificial Sequence
  Solute carrier family 12 member 2 (1012-1021)
uggcuguucgacgauggcgggcucacccuu

SEQ ID NO: 72016 - RNA, 18 nt, Artificial Sequence
  Serine/arginine-rich splicing factor 6 (107-112)
uggcuguuccacacccuc

SEQ ID NO: 72017 - RNA, 27 nt, Artificial Sequence
  Nuclear migration protein nudC (184-192)
uggcugaucgaggacggcaaggugguc

SEQ ID NO: 72018 - RNA, 18 nt, Artificial Sequence
  ATP-dependent RNA helicase DHX36 (885-890)
uggcugaucuaccaccuc

SEQ ID NO: 72019 - RNA, 33 nt, Artificial Sequence
  Liprin-beta-1 (649-659)
uggcugauggagcagggccucgggagcuaccuu

SEQ ID NO: 72020 - RNA, 30 nt, Artificial Sequence
  Tuberin (56-65)
uggcuggugggcaacaagcucgucaccguu

SEQ ID NO: 72021 - RNA, 27 nt, Artificial Sequence
  Vacuole membrane protein 1 (366-374)
uggauguucgagaagcugguggucguu

SEQ ID NO: 72022 - RNA, 27 nt, Artificial Sequence
  Hemicentin-1 (236-244)
uggagaauccccuucgacccuagccug

SEQ ID NO: 72023 - RNA, 27 nt, Artificial Sequence
  Hemicentin-2 (233-241)
uggagacugcccuucgacccuagccuc

SEQ ID NO: 72024 - RNA, 141 nt, Artificial Sequence
  ATP synthase subunit epsilon, mitochondrial (5-51)
uggagacaggccggccugagcuacaucagguauucccaaauuugcgcuaaggcagugcgggacgcccucaaaaccgaguucaaggcgaacgcugaaaaaacaucugggucaaaugucaagauaguuaaagugaagaaggag

SEQ ID NO: 72025 - RNA, 27 nt, Artificial Sequence
  Pleckstrin homology domain-containing family B member 2 (27-35)
uggagcgacggccaccugaucuacuau

SEQ ID NO: 72026 - RNA, 24 nt, Artificial Sequence
  Low-density lipoprotein receptor-related protein 2 (440-447)
uggaccgacacagugcagaacaag

SEQ ID NO: 72027 - RNA, 18 nt, Artificial Sequence
  Importin-7 (450-455)
ugggugcugcacuacuuc

SEQ ID NO: 72028 - RNA, 27 nt, Artificial Sequence
  Vimentin (290-298)
ugguacaagagcaaauucgccgaccug

SEQ ID NO: 72029 - RNA, 24 nt, Artificial Sequence
  Suppressor of SWI4 1 homolog (25-32)
uacgccgcuaacccccacagcuuc

SEQ ID NO: 72030 - RNA, 30 nt, Artificial Sequence
  Putative eukaryotic translation initiation factor 2 subunit 3-like protein (330-339)
uacgccgcucccggcgggcugaucggagug

SEQ ID NO: 72031 - RNA, 24 nt, Artificial Sequence
  A-kinase anchor protein 9 (284-291)
uacgccgacgagaagacccuguuc

SEQ ID NO: 72032 - RNA, 24 nt, Artificial Sequence
  E3 SUMO-protein ligase RanBP2 (3010-3017)
uacgccgacggcgaggcuaaggug

SEQ ID NO: 72033 - RNA, 24 nt, Artificial Sequence
  Proteasome subunit beta type-4 (160-167)
uacgccgacggcgagagcuuccug

SEQ ID NO: 72034 - RNA, 27 nt, Artificial Sequence
  ATP-binding cassette sub-family A member 2 (14-22)
uacgccgacaagcccgcuggcaccuau

SEQ ID NO: 72035 - RNA, 27 nt, Artificial Sequence
  Ankyrin repeat domain-containing protein 17 (1180-1188)
uacgccgaggugggcagaguccugcuc

SEQ ID NO: 72036 - RNA, 27 nt, Artificial Sequence
  Protein FAM208B (753-761)
uacgccuucagccuggacuccaaguau

SEQ ID NO: 72037 - RNA, 30 nt, Artificial Sequence
  Heterogeneous nuclear ribonucleoprotein L (250-259)
uacgccaagcccaccagacugaacguguuc

SEQ ID NO: 72038 - RNA, 30 nt, Artificial Sequence
  Rho GTPase-activating protein 5 (623-632)
uacgcccuggacggcaagaucuaugagcuc

SEQ ID NO: 72039 - RNA, 69 nt, Artificial Sequence
  Keratin, type I cytoskeletal 18 (273-295)
uacgcccugcagauggagcaacucaacggcauccuucugcacuuggaaagcgaguuagcucagaccaga

SEQ ID NO: 72040 - RNA, 33 nt, Artificial Sequence
  NAD(P)H dehydrogenase (quinone) 1 (43-53)
uacgccaugaacuucaaucccaucauuagcaga

SEQ ID NO: 72041 - RNA, 30 nt, Artificial Sequence
  Protein FAM73A (152-161)
uacgccaacggcgggcuguucagcaaguau

SEQ ID NO: 72042 - RNA, 27 nt, Artificial Sequence
  Coiled-coil domain-containing protein 34 (296-304)
uacgccaacggcaagcugaccggguuc

SEQ ID NO: 72043 - RNA, 24 nt, Artificial Sequence
  Tubulin alpha-1C chain (173-180)
uacgccagaggccacuauaccauc

SEQ ID NO: 72044 - RNA, 33 nt, Artificial Sequence
  Synaptojanin-2 (4-14)
uacgccagcggccccgcuccuccagcagggacc

SEQ ID NO: 72045 - RNA, 30 nt, Artificial Sequence
  Destrin (117-126)
uacgccagcuccaaggacgcuaucaaaaag

SEQ ID NO: 72046 - RNA, 27 nt, Artificial Sequence
  Tetratricopeptide repeat protein 14 (351-359)
uacgccaccaagggcagccugaacaaa

SEQ ID NO: 72047 - RNA, 21 nt, Artificial Sequence
  Serine/threonine-protein kinase LATS1 (731-737)
uacgccaccaagacacugaga

SEQ ID NO: 72048 - RNA, 24 nt, Artificial Sequence
  MAGUK p55 subfamily member 5 (117-124)
uacgccgugaagauccuggagauu

SEQ ID NO: 72049 - RNA, 27 nt, Artificial Sequence
  60S ribosomal protein L4 (52-60)
uacgccgugagcgagcuggcuggccac

SEQ ID NO: 72050 - RNA, 24 nt, Artificial Sequence
  Melanoma-associated antigen 4 (232-239)
uacgacggcagagagcacaccgug

SEQ ID NO: 72051 - RNA, 27 nt, Artificial Sequence
  Neurobeachin-like protein 1 (2364-2372)
uacgacagaaacaucagcaauuauuuc

SEQ ID NO: 72052 - RNA, 21 nt, Artificial Sequence
  Signal recognition particle subunit SRP68 (455-461)
uacgacagagugcugaaguau

SEQ ID NO: 72053 - RNA, 27 nt, Artificial Sequence
  DNA topoisomerase 2-alpha (1082-1090)
uacgacagcgaucccgugaaggccugg

SEQ ID NO: 72054 - RNA, 27 nt, Artificial Sequence
  Seizure 6-like protein 2 (844-852)
uacgaggccggcgacaccagagaauau

SEQ ID NO: 72055 - RNA, 27 nt, Artificial Sequence
  Protein SSX5 (55-63)
uacgaggccaugaccaagcugggcuuc

SEQ ID NO: 72056 - RNA, 27 nt, Artificial Sequence
  ATP-binding cassette sub-family C member 8 (1326-1334)
uacgagggccugcucgcccccagccuu

SEQ ID NO: 72057 - RNA, 21 nt, Artificial Sequence
  L-dopachrome tautomerase (303-309)
uacgagggccugcucagaagg

SEQ ID NO: 72058 - RNA, 24 nt, Artificial Sequence
  Melanophilin (122-129)
uacgagcacgugaaggccagauuc

SEQ ID NO: 72059 - RNA, 21 nt, Artificial Sequence
  Annexin A5 (94-100)
uacgagcugaagcacgcccuc

SEQ ID NO: 72060 - RNA, 27 nt, Artificial Sequence
  Gamma-secretase C-terminal fragment 59 (647-655)
uacgagaaccccaccuauaaguucuuu

SEQ ID NO: 72061 - RNA, 21 nt, Artificial Sequence
  39S ribosomal protein L20, mitochondrial (108-114)
uacgagcccaagaccuucaaa

SEQ ID NO: 72062 - RNA, 27 nt, Artificial Sequence
  Migration stimulation factor FN70 (392-400)
uacgagcaggaccaaaaguauagcuuc

SEQ ID NO: 72063 - RNA, 36 nt, Artificial Sequence
  Spectrin beta chain, non-erythrocytic 5 (750-761)
uacuucgccgacgcugcagaggccgcgagcuggcug

SEQ ID NO: 72064 - RNA, 21 nt, Artificial Sequence
  Glia-derived nexin (200-206)
uacuucaagggccuguggaaa

SEQ ID NO: 72065 - RNA, 27 nt, Artificial Sequence
  Serine-tRNA ligase, cytoplasmic (194-202)
uacuuccugaagggcgugcucgucuuu

SEQ ID NO: 72066 - RNA, 30 nt, Artificial Sequence
  Tyrosine-protein kinase receptor (124-133)
uacggcgccgcugggggaaagggugcaaaa

SEQ ID NO: 72067 - RNA, 30 nt, Artificial Sequence
  Hemoglobin subunit alpha (25-34)
uacggcgccgaggcucuggaaagaauguuc

SEQ ID NO: 72068 - RNA, 51 nt, Artificial Sequence
  Hemoglobin subunit alpha (25-41)
uacggcgccgaggcucuggaaagaauguuccucagcuuucccaccacaaag

SEQ ID NO: 72069 - RNA, 24 nt, Artificial Sequence
  Tubulin beta-6 chain (157-164)
uacggcgaccugaaccaccucgug

SEQ ID NO: 72070 - RNA, 24 nt, Artificial Sequence
  WD repeat-containing protein 3 (588-595)
uacggccacaagcugcccgugauc

SEQ ID NO: 72071 - RNA, 27 nt, Artificial Sequence
  Translocating chain-associated membrane protein 1 (75-83)
uacggcaucaaggaccuggccaccgug

SEQ ID NO: 72072 - RNA, 21 nt, Artificial Sequence
  U2 small nuclear ribonucleoprotein B'' (75-81)
uacggcaagcccaugagaauc

SEQ ID NO: 72073 - RNA, 21 nt, Artificial Sequence
  Nucleoporin NUP53 (179-185)
uacggcaacauccugaagcac

SEQ ID NO: 72074 - RNA, 27 nt, Artificial Sequence
  Filamin-A (1844-1852)
uacggccccgggcugacccacggagug

SEQ ID NO: 72075 - RNA, 21 nt, Artificial Sequence
  Vacuolar protein sorting-associated protein 51 homolog (123-129)
uacggccaggccgugagauau

SEQ ID NO: 72076 - RNA, 21 nt, Artificial Sequence
  Serine palmitoyltransferase 3 (290-296)
uacggccagcccagaaccagg

SEQ ID NO: 72077 - RNA, 21 nt, Artificial Sequence
  Tyrosine-protein kinase Fyn (385-391)
uacggcagauucaccaucaag

SEQ ID NO: 72078 - RNA, 48 nt, Artificial Sequence
  Annexin A2 (24-39)
uacggcagcgugaaggccuauaccaacuucgacgcugagagagaugca

SEQ ID NO: 72079 - RNA, 24 nt, Artificial Sequence
  Band 4.1-like protein 3 (187-194)
uacggcguggaccugcaccaugcc

SEQ ID NO: 72080 - RNA, 21 nt, Artificial Sequence
  Parafibromin (315-321)
uaccacggcaugacccugaag

SEQ ID NO: 72081 - RNA, 18 nt, Artificial Sequence
  Fibronectin type III domain-containing protein 3B (351-356)
uaccacgugagagucuau

SEQ ID NO: 72082 - RNA, 33 nt, Artificial Sequence
  cAMP-responsive element modulator (185-195)
uacaucgccauugcucagggcgggaccauacaa

SEQ ID NO: 72083 - RNA, 27 nt, Artificial Sequence
  HEAT repeat-containing protein 1 (1013-1021)
uacaucgccaaggaccugaugaaagug

SEQ ID NO: 72084 - RNA, 27 nt, Artificial Sequence
  Gamma-tubulin complex component 6 (1683-1691)
uacaucgccaaccagauucugcacgug

SEQ ID NO: 72085 - RNA, 27 nt, Artificial Sequence
  CAAX prenyl protease 1 homolog (218-226)
uacaucgccccccuguucgacaaguuu

SEQ ID NO: 72086 - RNA, 36 nt, Artificial Sequence
  Serum albumin (287-298)
uacaucugcgagaaccaggacagcauuuccucuaag

SEQ ID NO: 72087 - RNA, 27 nt, Artificial Sequence
  Ankyrin-2 (1793-1801)
uacaucgacgagcacggccauaccgug

SEQ ID NO: 72088 - RNA, 18 nt, Artificial Sequence
  E3 ubiquitin-protein ligase RNF216 (59-64)
uacaucgacuucaaguuu

SEQ ID NO: 72089 - RNA, 27 nt, Artificial Sequence
  Ribonuclease 3 (577-585)
uacaucgacaaggaucuggaguaugug

SEQ ID NO: 72090 - RNA, 27 nt, Artificial Sequence
  Eukaryotic translation initiation factor 3 subunit L (522-530)
uacaucgacaaggauaugauucacaua

SEQ ID NO: 72091 - RNA, 24 nt, Artificial Sequence
  Receptor tyrosine-protein kinase erbB-3 (148-155)
uacaucgagaagaacgacaaacug

SEQ ID NO: 72092 - RNA, 27 nt, Artificial Sequence
  Laminin subunit beta-1 (396-404)
uacaucgagaagguggucuauaccguu

SEQ ID NO: 72093 - RNA, 24 nt, Artificial Sequence
  26S proteasome non-ATPase regulatory subunit 8 (132-139)
uacaucaagcaccccgugagccug

SEQ ID NO: 72094 - RNA, 24 nt, Artificial Sequence
  Retinoblastoma-like protein 2 (1013-1020)
uacaucaagcagauuaaaaccuuc

SEQ ID NO: 72095 - RNA, 27 nt, Artificial Sequence
  Exostosin-2 (348-356)
uacauccugcccuucagcgaggugcuc

SEQ ID NO: 72096 - RNA, 30 nt, Artificial Sequence
  E3 ubiquitin-protein ligase RNF114 (116-125)
uacaucauggagggcgugaaggccaccauu

SEQ ID NO: 72097 - RNA, 27 nt, Artificial Sequence
  Cytoplasmic dynein 1 heavy chain 1 (2489-2497)
uacauccagagauaucugguguacgcc

SEQ ID NO: 72098 - RNA, 27 nt, Artificial Sequence
  Ceramide synthase 2 (78-86)
uacaucagagccggcacccugauuaug

SEQ ID NO: 72099 - RNA, 27 nt, Artificial Sequence
  Kinesin-like protein KIF11 (399-407)
uacaucagcgaggaaaacuucagagug

SEQ ID NO: 72100 - RNA, 24 nt, Artificial Sequence
  Cleft lip and palate transmembrane protein 1 (108-115)
uacaucagcgagcacgaacauuuc

SEQ ID NO: 72101 - RNA, 27 nt, Artificial Sequence
  V-type proton ATPase subunit B, brain isoform (266-274)
uacaucaccgagggccagauuuaugug

SEQ ID NO: 72102 - RNA, 30 nt, Artificial Sequence; identical to SEQ ID NO: 47875
  E3 ubiquitin-protein ligase HERC2 (1123-1132)

SEQ ID NO: 72103 - RNA, 30 nt, Artificial Sequence
  Dedicator of cytokinesis protein 7 (457-466)
uacaucuauccccagagccugaacuucgcc

SEQ ID NO: 72104 - RNA, 21 nt, Artificial Sequence
  Eukaryotic peptide chain release factor GTP-binding subunit ERF3A (309-315)
uacaaggacaugggcaccgug

SEQ ID NO: 72105 - RNA, 21 nt, Artificial Sequence
  Store-operated calcium entry-associated regulatory factor (105-111)
uacaaguucggcaaaaccgug

SEQ ID NO: 72106 - RNA, 21 nt, Artificial Sequence
  Ras-related protein Rab-20 (158-164)
uacaagaaaauccugaaguau

SEQ ID NO: 72107 - RNA, 30 nt, Artificial Sequence
  Cytochrome c oxidase subunit 5B, mitochondrial (120-129)
uacaagcuggugccccagcaacucgcccac

SEQ ID NO: 72108 - RNA, 24 nt, Artificial Sequence
  Alpha-2-macroglobulin (163-170)
uacaagcccggccagaccgugaaa

SEQ ID NO: 72109 - RNA, 24 nt, Artificial Sequence
  Fanconi anemia group I protein (1039-1046)
uacaagagccccgugauccugcuc

SEQ ID NO: 72110 - RNA, 27 nt, Artificial Sequence
  Thioredoxin-interacting protein (221-229)
uaccuggccaacggccagaccaaggug

SEQ ID NO: 72111 - RNA, 30 nt, Artificial Sequence
  Laminin subunit gamma-1 (667-676)
uaccuggacgaugugacccucgccagcgcu

SEQ ID NO: 72112 - RNA, 27 nt, Artificial Sequence
  Dedicator of cytokinesis protein 7 (628-636)
uaccuggacaaguucuuugcccucgug

SEQ ID NO: 72113 - RNA, 27 nt, Artificial Sequence
  Dedicator of cytokinesis protein 6 (723-731)
uaccuggacaaguucuuuacccucgug

SEQ ID NO: 72114 - RNA, 27 nt, Artificial Sequence
  Zinc finger protein 573 (42-50)
uaccuggaccccaaccagagagaucuc

SEQ ID NO: 72115 - RNA, 27 nt, Artificial Sequence
  Kinesin-like protein KIF13B (1105-1113)
uaccuggaccagcaacuccagaagcuu

SEQ ID NO: 72116 - RNA, 24 nt, Artificial Sequence
  ATP-binding cassette sub-family E member 1 (491-498)
uaccuggacagcgagcagagacuc

SEQ ID NO: 72117 - RNA, 27 nt, Artificial Sequence
  Laminin subunit beta-1 (1753-1761)
uaccuggaggacaaggcccaggaacuc

SEQ ID NO: 72118 - RNA, 27 nt, Artificial Sequence
  Enhancer of mRNA-decapping protein 4 (906-914)
uaccuggaggaagccgugaugcaccuc

SEQ ID NO: 72119 - RNA, 27 nt, Artificial Sequence
  Inositol-trisphosphate 3-kinase A (270-278)
uaccuggaggaagagcucaccaaggcc

SEQ ID NO: 72120 - RNA, 24 nt, Artificial Sequence
  Ubiquitin carboxyl-terminal hydrolase 7 (1093-1100)
uaccuggagaaggccaucaaaauu

SEQ ID NO: 72121 - RNA, 24 nt, Artificial Sequence
  Plectin (1070-1077)
uaccuggagaagcucaaaaccauc

SEQ ID NO: 72122 - RNA, 27 nt, Artificial Sequence
  Heparan-sulfate 6-O-sulfotransferase 2 (442-450)
uaccuguucgagaagaccuuuaacaug

SEQ ID NO: 72123 - RNA, 27 nt, Artificial Sequence
  Thioredoxin domain-containing protein 16 (103-111)
uaccuguucaagggcaacauccuccuu

SEQ ID NO: 72124 - RNA, 27 nt, Artificial Sequence
  Bax inhibitor 1 (186-194)
uaccuguuccucggcgggauccuuaug

SEQ ID NO: 72125 - RNA, 27 nt, Artificial Sequence
  T-box transcription factor TBX3 (251-259)
uaccuguuccccgagaccgaauuuauc

SEQ ID NO: 72126 - RNA, 27 nt, Artificial Sequence
  Cyclin-dependent kinase 2 (107-115)
uaccuguuccagcuccuucaaggccug

SEQ ID NO: 72127 - RNA, 27 nt, Artificial Sequence
  Electroneutral sodium bicarbonate exchanger 1 (1036-1044)
uaccugggcgccagcaacuauagaacc

SEQ ID NO: 72128 - RNA, 27 nt, Artificial Sequence
  Hexokinase-1 (749-757)
uaccugggcgagaucgugagaaacauu

SEQ ID NO: 72129 - RNA, 24 nt, Artificial Sequence
  Clustered mitochondria protein homolog (510-517)
uaccugggcaaggugcucgagcuu

SEQ ID NO: 72130 - RNA, 27 nt, Artificial Sequence
  Putative ATP-dependent RNA helicase DHX33 (179-187)
uaccugcacgccgcucucgugagcguc

SEQ ID NO: 72131 - RNA, 21 nt, Artificial Sequence
  Rho-related BTB domain-containing protein 3 (560-566)
uaccugaucuucagccagaag

SEQ ID NO: 72132 - RNA, 27 nt, Artificial Sequence
  E3 ubiquitin-protein ligase TRIM36 (266-274)
uaccugaucggcaaggagagccaggug

SEQ ID NO: 72133 - RNA, 27 nt, Artificial Sequence
  ER membrane protein complex subunit 4 (136-144)
uaccugaucggcaaccucauggggcuu

SEQ ID NO: 72134 - RNA, 27 nt, Artificial Sequence
  F-box only protein 21 (364-372)
uaccugaucggccagcacgugaccgcc

SEQ ID NO: 72135 - RNA, 27 nt, Artificial Sequence
  Dolichyl-diphosphooligosaccharide-proteinosyltransferase subunit 2 (343-351)
uaccugaucauuggcgacgccacccuc

SEQ ID NO: 72136 - RNA, 30 nt, Artificial Sequence
  Nuclear export mediator factor NEMF (539-548)
uaccugaucauuggcgggagagaccagcaa

SEQ ID NO: 72137 - RNA, 27 nt, Artificial Sequence
  60S ribosomal protein L3 (286-294)
uaccugaucaaggacggcaaacucauu

SEQ ID NO: 72138 - RNA, 27 nt, Artificial Sequence
  WD repeat-containing protein 6 (703-711)
uaccugaaggacggcgaugugaugcuc

SEQ ID NO: 72139 - RNA, 21 nt, Artificial Sequence
  SFRS17A protein (23-29)
uaccugaagcccaucaccaaa

SEQ ID NO: 72140 - RNA, 30 nt, Artificial Sequence
  TRPM8 channel-associated factor 2 (446-455)
uaccugcucgagggccagaacgccgaagug

SEQ ID NO: 72141 - RNA, 27 nt, Artificial Sequence
  Maestro heat-like repeat-containing protein family member 7 (965-973)
uaccugcucaucccccuucuggagaga

SEQ ID NO: 72142 - RNA, 30 nt, Artificial Sequence
  Translocating chain-associated membrane protein 1 (211-220)
uaccugcucaaccuuaaucaccugggcuug

SEQ ID NO: 72143 - RNA, 30 nt, Artificial Sequence
  Synemin (706-715)
uaccugcucagcaaggacaucaaagaggug

SEQ ID NO: 72144 - RNA, 33 nt, Artificial Sequence; identical to SEQ ID NO: 47917
  E3 ubiquitin-protein ligase RNF213 (2078-2088)

SEQ ID NO: 72145 - RNA, 27 nt, Artificial Sequence
  Nesprin-1 (1560-1568)
uaccugauggaggccagauauagccuc

SEQ ID NO: 72146 - RNA, 27 nt, Artificial Sequence
  Leucine-rich repeat and calponin homology domain-containing protein 1 (147-155)
uaccugaaccucagcagaaaucagcuu

SEQ ID NO: 72147 - RNA, 27 nt, Artificial Sequence
  Kinesin-like protein KIF13B (1450-1458)
uaccugaaccccgugaagagcuucguc

SEQ ID NO: 72148 - RNA, 27 nt, Artificial Sequence
  Inactive ubiquitin carboxyl-terminal hydrolase 53 (271-279)
uaccugcccggccucuucuauagagug

SEQ ID NO: 72149 - RNA, 27 nt, Artificial Sequence
  Sterol regulatory element-binding protein 1 (1096-1104)
uaccugcccccuggcuuccucagcgcc

SEQ ID NO: 72150 - RNA, 27 nt, Artificial Sequence
  La-related protein 4 (424-432)
uaccugcagaaggagaccagcacacuc

SEQ ID NO: 72151 - RNA, 30 nt, Artificial Sequence
  Calcium/calmodulin-dependent 3',5'-cyclic nucleotide phosphodiesterase 1C (18-27)
uaccugcagcccgagcaaaucgaaaagauu

SEQ ID NO: 72152 - RNA, 18 nt, Artificial Sequence
  Tyrosine-protein phosphatase non-receptor type 23 (30-35)
uaccugagagagcacuuc

SEQ ID NO: 72153 - RNA, 30 nt, Artificial Sequence
  Ubiquitin-like modifier-activating enzyme 7 (247-256)
uaccugagaggcggggccaucaccgaggug

SEQ ID NO: 72154 - RNA, 33 nt, Artificial Sequence
  Protein dopey-1 (743-753)
uaccugagcgccuuccucgcugcaugccagcuu

SEQ ID NO: 72155 - RNA, 30 nt, Artificial Sequence; identical to SEQ ID NO: 47928
  2-hydroxyacylsphingosine 1-beta-galactosyltransferase (299-308)

SEQ ID NO: 72156 - RNA, 27 nt, Artificial Sequence
  Trafficking kinesin-binding protein 2 (496-504)
uaccugagcgagaagcaguucuuugcc

SEQ ID NO: 72157 - RNA, 27 nt, Artificial Sequence
  Coatomer subunit beta' (490-498)
uaccugagcgagaaggugcucgccgcu

SEQ ID NO: 72158 - RNA, 27 nt, Artificial Sequence
  Rho GTPase-activating protein 1 (214-222)
uaccugagcgagcucuccgaacacgug

SEQ ID NO: 72159 - RNA, 24 nt, Artificial Sequence
  Polyadenylate-binding protein-interacting protein 1 (112-119)
uaccugagccaccaucucaccauc

SEQ ID NO: 72160 - RNA, 27 nt, Artificial Sequence
  Alpha-N-acetylglucosaminidase (583-591)
uaccugagcaaggagcucgccucccuu

SEQ ID NO: 72161 - RNA, 27 nt, Artificial Sequence
  Cytoplasmic dynein 1 heavy chain 1 (3552-3560)
uaccugagcaacgccgacgagagacuc

SEQ ID NO: 72162 - RNA, 27 nt, Artificial Sequence
  Serine/threonine-protein kinase A-Raf (529-537)
uaccugagccccgaccucuccaagauc

SEQ ID NO: 72163 - RNA, 27 nt, Artificial Sequence
  UDP-glucose:glycoprotein glucosyltransferase 2 (1269-1277)
uaccugagccccaccuucaaggaggug

SEQ ID NO: 72164 - RNA, 27 nt, Artificial Sequence
  Cathepsin D (150-158)
uaccugagccaggacaccguguccguc

SEQ ID NO: 72165 - RNA, 27 nt, Artificial Sequence
  Plexin-B3 (1418-1426)
uaccugaccgacaucaugagaacacuc

SEQ ID NO: 72166 - RNA, 42 nt, Artificial Sequence
  Plexin-B3 (1418-1431)
uaccugaccgacaucaugagaacacuccuuggcgaucuggcc

SEQ ID NO: 72167 - RNA, 27 nt, Artificial Sequence
  Alpha-1,3-mannosyl-glycoprotein 4-beta-N-acetylglucosaminyltransferase B (56-64)
uaccugaccgacacacuccacagccuu

SEQ ID NO: 72168 - RNA, 27 nt, Artificial Sequence
  Apoptosis-associated speck-like protein containing a CARD (184-192)
uaccugguggaggaccucgaaagaagc

SEQ ID NO: 72169 - RNA, 27 nt, Artificial Sequence
  Probable ATP-dependent RNA helicase DDX47 (248-256)
uaccugguguauauccucaacgagcuu

SEQ ID NO: 72170 - RNA, 21 nt, Artificial Sequence
  Serum albumin (162-168)
uaccuguaugagaucgccaga

SEQ ID NO: 72171 - RNA, 27 nt, Artificial Sequence
  Protein sel-1 homolog 1 (457-465)
uaccuguauggcagaggggugcagguc

SEQ ID NO: 72172 - RNA, 30 nt, Artificial Sequence
  Probable G-protein coupled receptor 158 (82-91)
uaccuguauaccggcgacagccaccagcuc

SEQ ID NO: 72173 - RNA, 27 nt, Artificial Sequence
  Cytochrome c oxidase subunit 7A-related protein, mitochondrial (106-114)
uacauggccagccagcccaagaacaaa

SEQ ID NO: 72174 - RNA, 27 nt, Artificial Sequence
  Hemicentin-2 (2923-2931)
uacaugugcguggccgagaaccaggcu

SEQ ID NO: 72175 - RNA, 27 nt, Artificial Sequence
  Protein shisa-5 (129-137)
uacauggacgcccccaaggcugcacug

SEQ ID NO: 72176 - RNA, 30 nt, Artificial Sequence
  Lysosomal-trafficking regulator (1891-1900)
uacaugaacgagaauggcgaauucaagcug

SEQ ID NO: 72177 - RNA, 27 nt, Artificial Sequence
  Phosphatidylinositol N-acetylglucosaminyltransferase subunit H (129-137)
uacaugcagaaggugaucuauuaccug

SEQ ID NO: 72178 - RNA, 24 nt, Artificial Sequence
  Transmembraneoprotein NMB (37-44)
uacaugagagagcacaaccagcug

SEQ ID NO: 72179 - RNA, 18 nt, Artificial Sequence
  Histone-lysine N-methyltransferase ASH1L (2260-2265)
uacaacuuccacagcuuu

SEQ ID NO: 72180 - RNA, 27 nt, Artificial Sequence
  Actin-related protein 2 (225-233)
uacaacaucgagcaggaacaaaagcug

SEQ ID NO: 72181 - RNA, 24 nt, Artificial Sequence
  26S proteasome non-ATPase regulatory subunit 8 (148-155)
uacaacaagguguuccuggccaaa

SEQ ID NO: 72182 - RNA, 24 nt, Artificial Sequence
  Serine-protein kinase ATM (1148-1155)
uacaacagaaagagcgugcugcuc

SEQ ID NO: 72183 - RNA, 72 nt, Artificial Sequence
  Alanine-tRNA ligase, cytoplasmic (487-510)
uacaacuaucaccuggacagcuccggcucuuacguguucgagaauaccgucgccacaguuauggcucucaga

SEQ ID NO: 72184 - RNA, 24 nt, Artificial Sequence
  PHD finger protein 20 (103-110)
uaccccgccaaggugaccgcuguc

SEQ ID NO: 72185 - RNA, 27 nt, Artificial Sequence
  Supervillin (1594-1602)
uaccccgccagagcuccuagcgugguc

SEQ ID NO: 72186 - RNA, 30 nt, Artificial Sequence
  Ras GTPase-activating protein nGAP (628-637)
uaccccgacgauagaaccagcaggacacug

SEQ ID NO: 72187 - RNA, 24 nt, Artificial Sequence
  Splicing factor 3B subunit 3 (520-527)
uaccccgacggcaucagacacauu

SEQ ID NO: 72188 - RNA, 27 nt, Artificial Sequence
  Vacuolar protein sorting-associated protein 13B (2316-2324)
uaccccgagccuagagugcugacccuc

SEQ ID NO: 72189 - RNA, 24 nt, Artificial Sequence
  Constitutive coactivator of peroxisome proliferator-activated receptor gamma (665-672)
uaccccggcaacccucugagacac

SEQ ID NO: 72190 - RNA, 21 nt, Artificial Sequence
  Heterogeneous nuclear ribonucleoprotein U-like protein 1 (369-375)
uacccccacgugcuggucaag

SEQ ID NO: 72191 - RNA, 27 nt, Artificial Sequence
  Actin, cytoplasmic 2 (69-77)
uaccccaucgagcacggcauugugacc

SEQ ID NO: 72192 - RNA, 27 nt, Artificial Sequence
  Isoleucine-tRNA ligase, cytoplasmic (845-853)
uacccccugaaggagaucguggucauu

SEQ ID NO: 72193 - RNA, 27 nt, Artificial Sequence
  Transmembrane protein 98 (147-155)
uaccccccucuggacccaaagcuccuu

SEQ ID NO: 72194 - RNA, 27 nt, Artificial Sequence
  Fatty aldehyde dehydrogenase (440-448)
uaccccccuaacagccaguccaaggug

SEQ ID NO: 72195 - RNA, 33 nt, Artificial Sequence
  All-trans-retinol 13,14-reductase (15-25)
uaccccagaggcgggagcuccgagaucgccuuc

SEQ ID NO: 72196 - RNA, 24 nt, Artificial Sequence
  Syntenin-1 (46-53)
uaccccagacuguauccugagcuc

SEQ ID NO: 72197 - RNA, 27 nt, Artificial Sequence
  Protocadherin gamma-C3 (569-577)
uaccccagaccuggcgggagcuccgug

SEQ ID NO: 72198 - RNA, 30 nt, Artificial Sequence
  Phosphatidylcholine translocator ABCB4 (403-412)
uaccccagcagagccaacgugaagauccug

SEQ ID NO: 72199 - RNA, 30 nt, Artificial Sequence
  AT-rich interactive domain-containing protein 1A (921-930)
uaccccuauggcgggccuuacgacagagug

SEQ ID NO: 72200 - RNA, 27 nt, Artificial Sequence
  Ataxin-2-like protein (1021-1029)
uaccccuauaucggccacccucaggug

SEQ ID NO: 72201 - RNA, 27 nt, Artificial Sequence
  Desmin (387-395)
uaccaggaccugcucaacgugaagaug

SEQ ID NO: 72202 - RNA, 27 nt, Artificial Sequence
  Laminin subunit beta-1 (934-942)
uaccaggaccccgugacccugcaacuc

SEQ ID NO: 72203 - RNA, 24 nt, Artificial Sequence
  Vimentin (358-365)
uaccaggacaccaucggcagacug

SEQ ID NO: 72204 - RNA, 36 nt, Artificial Sequence
  Regulator of nonsense transcripts 1 (154-165)
uaccagcacggcggggugaccggacugagccaauau

SEQ ID NO: 72205 - RNA, 24 nt, Artificial Sequence
  AP-5 complex subunit zeta-1 (389-396)
uaccagcaccuguucaccagaauc

SEQ ID NO: 72206 - RNA, 21 nt, Artificial Sequence
  Cytoplasmic dynein 1 heavy chain 1 (2959-2965)
uaccagaucaaggugcacaga

SEQ ID NO: 72207 - RNA, 24 nt, Artificial Sequence
  Bardet-Biedl syndrome 4 protein (46-53)
uaccagaaggccuucgagcaccug

SEQ ID NO: 72208 - RNA, 27 nt, Artificial Sequence
  Remodeling and spacing factor 1 (52-60)
uaccagcuggaccaagaucacaacgug

SEQ ID NO: 72209 - RNA, 27 nt, Artificial Sequence
  Exportin-7 (341-349)
uaccagcugggcgagcucgugaagguc

SEQ ID NO: 72210 - RNA, 27 nt, Artificial Sequence
  T-box transcription factor TBX3 (264-272)
uaccagaacgacaagaucacccaacug

SEQ ID NO: 72211 - RNA, 24 nt, Artificial Sequence
  Rho GTPase-activating protein 5 (414-421)
uaccagaaccacgugcaacaucug

SEQ ID NO: 72212 - RNA, 24 nt, Artificial Sequence
  Zinc finger MYM-type protein 4 (345-352)
uaccagaacgugguccacaagcug

SEQ ID NO: 72213 - RNA, 24 nt, Artificial Sequence
  Signal transducer and activator of transcription 6 (88-95)
uaccagagagacccccugaagcuc

SEQ ID NO: 72214 - RNA, 27 nt, Artificial Sequence
  TBC1 domain family member 16 (260-268)
uaccagaccgacuauuuccaccuguuu

SEQ ID NO: 72215 - RNA, 30 nt, Artificial Sequence
  Fatty acid synthase (959-968)
uaccagugggacgaucccgacccuagacug

SEQ ID NO: 72216 - RNA, 24 nt, Artificial Sequence
  Homeodomain-interacting protein kinase 4 (181-188)
uacagagcccccgagauccugcuc

SEQ ID NO: 72217 - RNA, 24 nt, Artificial Sequence
  Glycogen synthase kinase-3 beta (222-229)
uacagagcccccgagcugaucuuc

SEQ ID NO: 72218 - RNA, 27 nt, Artificial Sequence
  Protocadherin gamma-C3 (727-735)
uacagagcccccgugagcucccuguau

SEQ ID NO: 72219 - RNA, 27 nt, Artificial Sequence
  Proteasome subunit beta type-4 (223-231)
uacagagacgccaggagcuauaaccgg

SEQ ID NO: 72220 - RNA, 24 nt, Artificial Sequence
  Pyruvate kinase PKM (392-399)
uacagaggcaucuuccccgugcug

SEQ ID NO: 72221 - RNA, 36 nt, Artificial Sequence
  Alpha-enolase (33-44)
uacagacacaucgccgaccuggcuggcaacagcgag

SEQ ID NO: 72222 - RNA, 33 nt, Artificial Sequence
  Chondroitin sulfate proteoglycan 4 (1979-1989)
uacagacugauccagggcccccaauaugggcac

SEQ ID NO: 72223 - RNA, 27 nt, Artificial Sequence
  SLIT and NTRK-like protein 2 (712-720)
uacagaaaccugcaggaguucagcuau

SEQ ID NO: 72224 - RNA, 24 nt, Artificial Sequence
  HIG1 domain family member 2A, mitochondrial (29-36)
uacagaaaccccgagagcuucaag

SEQ ID NO: 72225 - RNA, 27 nt, Artificial Sequence
  Glycogen phosphorylase, brain form (792-800)
uacagaaaccccaaggaguggaccaaa

SEQ ID NO: 72226 - RNA, 24 nt, Artificial Sequence
  Dual specificity protein kinase CLK3 (317-324)
uacagacccccugaggugauccug

SEQ ID NO: 72227 - RNA, 21 nt, Artificial Sequence
  Chromodomain-helicase-DNA-binding protein 4 (169-175)
uacagaacccugacaaacuau

SEQ ID NO: 72228 - RNA, 27 nt, Artificial Sequence
  ATP-dependent RNA helicase DDX3X (243-251)
uacagcgacggccccggggaggcccug

SEQ ID NO: 72229 - RNA, 30 nt, Artificial Sequence
  Transcription factor SOX-10 (402-411)
uacagcgaccaccagcccuccggcccuuau

SEQ ID NO: 72230 - RNA, 33 nt, Artificial Sequence
  Transcription factor SOX-10 (402-412)
uacagcgaccaccagcccuccggcccuuauuac

SEQ ID NO: 72231 - RNA, 27 nt, Artificial Sequence
  Rab3 effector-like (158-166)
uacagcgaccccuucgugaaggucuau

SEQ ID NO: 72232 - RNA, 36 nt, Artificial Sequence
  Lysosomal-trafficking regulator (864-875)
uacagcgacuccccccagucucugucaaaguucuau

SEQ ID NO: 72233 - RNA, 27 nt, Artificial Sequence
  Unconventional myosin-XVIIIa (454-462)
uacagcgagaaggugaugcacauguuc

SEQ ID NO: 72234 - RNA, 27 nt, Artificial Sequence
  DNA polymerase alpha catalytic subunit (732-740)
uacagcgaguccucucagcugcucuau

SEQ ID NO: 72235 - RNA, 30 nt, Artificial Sequence
  AF4/FMR2 family member 4 (970-979)
uacagcgagaccguggaccugaucaaguau

SEQ ID NO: 72236 - RNA, 24 nt, Artificial Sequence
  CDK5 regulatory subunit-associated protein 3 (494-501)
uacagcggcagacccgugaaccug

SEQ ID NO: 72237 - RNA, 21 nt, Artificial Sequence
  SAM and SH3 domain-containing protein 1 (307-313)
uacagcggcgugcacaagaaa

SEQ ID NO: 72238 - RNA, 27 nt, Artificial Sequence
  Nucleolar pre-ribosomal-associated protein 1 (1469-1477)
uacagccaccuggagggcgccagauuc

SEQ ID NO: 72239 - RNA, 24 nt, Artificial Sequence
  Inositol 1,4,5-trisphosphate receptor type 3 (2259-2266)
uacagcaucagaccccugauugug

SEQ ID NO: 72240 - RNA, 21 nt, Artificial Sequence
  Rho-associated protein kinase 1 (287-293)
uacagcaagaucaugaaccac

SEQ ID NO: 72241 - RNA, 21 nt, Artificial Sequence
  Proteasome activator complex subunit 4 (40-46)
uacagcaagaccgagcaccug

SEQ ID NO: 72242 - RNA, 27 nt, Artificial Sequence
  Melanoma-associated antigen D2 (326-334)
uacagccuggagaagguguucggcauc

SEQ ID NO: 72243 - RNA, 48 nt, Artificial Sequence
  PERQ amino acid-rich with GYF domain-containing protein 1 (739-754)
uacagccugcacggcuccucuggggagaucgaaucaguggacgauuau

SEQ ID NO: 72244 - RNA, 24 nt, Artificial Sequence
  60S ribosomal protein L6 (63-70)
uacagcagaaaggccauguauaaa

SEQ ID NO: 72245 - RNA, 24 nt, Artificial Sequence
  BTB/POZ domain-containing protein KCTD20 (143-150)
uacagcuccaagcuguauagauuc

SEQ ID NO: 72246 - RNA, 42 nt, Artificial Sequence
  Eukaryotic translation initiation factor 3 subunit D (59-72)
uacagcucccaguucggcgggggaucucaauaugccuacuuu

SEQ ID NO: 72247 - RNA, 27 nt, Artificial Sequence
  Bromo adjacent homology domain-containing 1 protein (744-752)
uacagcacccccccucacagaacagug

SEQ ID NO: 72248 - RNA, 69 nt, Artificial Sequence
  Actin, gamma-enteric smooth muscle (295-317)
uacagcguguggaucggcggguccauucuggccucucucucaaccuuccagcaaauguggauaaguaag

SEQ ID NO: 72249 - RNA, 108 nt, Artificial Sequence
  Actin, cytoplasmic 2 (337-372)
uacagcguguggaucggcggguccauucuggccucucucucaaccuuccagcaaauguggauaaguaagcaggaguaugacgaaagcggacccuccaucguccacaga

SEQ ID NO: 72250 - RNA, 27 nt, Artificial Sequence
  Uncharacterized protein C5orf34 (326-334)
uacagcuaucccgagcuggugaagaug

SEQ ID NO: 72251 - RNA, 27 nt, Artificial Sequence
  Citrate synthase, mitochondrial (189-197)
uacaccgaccaccaguucacagagcug

SEQ ID NO: 72252 - RNA, 24 nt, Artificial Sequence
  Guanine nucleotide-binding protein subunit beta-2-like 1 (302-309)
uacaccgacaaccuggugagaguc

SEQ ID NO: 72253 - RNA, 30 nt, Artificial Sequence
  Transcription factor SOX-10 (369-378)
uacaccgaccagcccagcacaucccaaauc

SEQ ID NO: 72254 - RNA, 24 nt, Artificial Sequence
  WD repeat-containing protein 1 (54-61)
uacaccgagcacgcccaucaggug

SEQ ID NO: 72255 - RNA, 21 nt, Artificial Sequence
  Protocadherin Fat 2 (2518-2524)
uacaccaucauuaacaagcug

SEQ ID NO: 72256 - RNA, 24 nt, Artificial Sequence
  1,2-dihydroxy-3-keto-5-methylthiopentene dioxygenase (142-149)
uacaccaaggccaugagacuguuc

SEQ ID NO: 72257 - RNA, 39 nt, Artificial Sequence
  Syndecan-3 (419-431)
uacacccuggaggaacccaagcaggccagcgugacauau

SEQ ID NO: 72258 - RNA, 27 nt, Artificial Sequence
  Trophinin (94-102)
uacacccuggagaagauguucagagug

SEQ ID NO: 72259 - RNA, 27 nt, Artificial Sequence
  Zinc finger E-box-binding homeobox 2 (504-512)
uacacccuggagaaggugaacgaagcc

SEQ ID NO: 72260 - RNA, 30 nt, Artificial Sequence
  Probable ATP-dependent RNA helicase DDX5 (540-549)
uacaccaacggcagcuucggguccaauuuu

SEQ ID NO: 72261 - RNA, 66 nt, Artificial Sequence
  Fructose-bisphosphate aldolase A (397-418)
uacacccccagcggccaggccggggcugcagccuccgagucucuguucgugucaaaccacgcguau

SEQ ID NO: 72262 - RNA, 27 nt, Artificial Sequence
  DNA replication licensing factor MCM3 (251-259)
uacaccagcggcacauucagaacugug

SEQ ID NO: 72263 - RNA, 42 nt, Artificial Sequence
  Melanocyte protein PMEL (265-278)
uacaccugggacuucggcgauagcuccgggacacugaucucu

SEQ ID NO: 72264 - RNA, 51 nt, Artificial Sequence
  Melanocyte protein PMEL (265-281)
uacaccugggacuucggcgauagcuccgggacacugaucucuagagcccuc

SEQ ID NO: 72265 - RNA, 30 nt, Artificial Sequence
  Adenylate cyclase type 6 (111-120)
uacguggccugcgcucugcucgucuucugu

SEQ ID NO: 72266 - RNA, 30 nt, Artificial Sequence
  Lysine-specific histone demethylase 1A (121-130)
uacguggccgaccugggcgcuauggucguu

SEQ ID NO: 72267 - RNA, 24 nt, Artificial Sequence
  HLA class I histocompatibility antigen, B-49 alpha chain (51-58)
uacguggacgauacccuguucguc

SEQ ID NO: 72268 - RNA, 24 nt, Artificial Sequence
  HLA class I histocompatibility antigen, B-13 alpha chain (26-33)
uacguggacgauacccaguucguc

SEQ ID NO: 72269 - RNA, 30 nt, Artificial Sequence
  HLA class I histocompatibility antigen, Cw-5 alpha chain (51-60)
uacguggacgauacccaguucguccaauuu

SEQ ID NO: 72270 - RNA, 33 nt, Artificial Sequence
  HLA class I histocompatibility antigen, B-13 alpha chain (26-36)
uacguggacgauacccaguucgucagauuugac

SEQ ID NO: 72271 - RNA, 36 nt, Artificial Sequence
  HLA class I histocompatibility antigen, B-13 alpha chain (26-37)
uacguggacgauacccaguucgucagauuugacagc

SEQ ID NO: 72272 - RNA, 30 nt, Artificial Sequence; identical to SEQ ID NO: 48045
  Helicase SKI2W (1066-1075)

SEQ ID NO: 72273 - RNA, 30 nt, Artificial Sequence
  40S ribosomal protein S16 (98-107)
uacguggacgaggccagcaagaaagaaauc

SEQ ID NO: 72274 - RNA, 24 nt, Artificial Sequence
  Angiomotin-like protein 1 (605-612)
uacguggagaaggucgaaaaacug

SEQ ID NO: 72275 - RNA, 24 nt, Artificial Sequence
  Angiomotin-like protein 2 (482-489)
uacguggagaaggucgaaagacug

SEQ ID NO: 72276 - RNA, 21 nt, Artificial Sequence
  Melanoma-derived growth regulatory protein (71-77)
uacguguucagcaagcugaaa

SEQ ID NO: 72277 - RNA, 27 nt, Artificial Sequence
  Glutamine-tRNA ligase (632-640)
uacgugaucgagcugcagcacgucguu

SEQ ID NO: 72278 - RNA, 30 nt, Artificial Sequence
  E3 ubiquitin-protein ligase Arkadia (683-692)
uacgugaucccccacccuguccaugccuuc

SEQ ID NO: 72279 - RNA, 27 nt, Artificial Sequence
  Apoptosis-resistant E3 ubiquitin protein ligase 1 (356-364)
uacgugagccccaagcaguucuccguc

SEQ ID NO: 72280 - RNA, 24 nt, Artificial Sequence
  Signal transducer and activator of transcription 2 (829-836)
uacgugagcagacccucccacuuc

SEQ ID NO: 72281 - RNA, 27 nt, Artificial Sequence
  Serine/threonine-protein kinase SMG1 (424-432)
uacgugaccgacguccuguauagaguu

SEQ ID NO: 72282 - RNA, 36 nt, Artificial Sequence
  Filamin-A (2047-2058)
uacgugaccgagaucgaccaggauaaguaugccguc

SEQ ID NO: 72283 - RNA, 27 nt, Artificial Sequence
  Fructose-bisphosphate aldolase A (258-266)
uacgugaccgagaagguccuggccgcu

SEQ ID NO: 72284 - RNA, 27 nt, Artificial Sequence
  Tensin-1 (17-25)
uacgugaccgagagaaucauugccguc

SEQ ID NO: 72285 - RNA, 27 nt, Artificial Sequence
  Membrane-associated transporter protein (55-63)
uacgugacccccguccugcucagcguu

SEQ ID NO: 72286 - RNA, 30 nt, Artificial Sequence
  Attractin (187-196)
uacguguaugacggcgauagcaucuacgcc

SEQ ID NO: 72287 - RNA, 21 nt, Artificial Sequence
  Histone H2B type 2-F (41-47)
uacguguauaagguccugaaa

SEQ ID NO: 72288 - RNA, 21 nt, Artificial Sequence
  40S ribosomal protein S29 (7-13)
uacuggagccaccccagaaag

SEQ ID NO: 72289 - RNA, 96 nt, Artificial Sequence
  Keratin, type I cytoskeletal 18 (212-243)
uacuggagccagcaaaucgaggaauccaccacaguggucacuacgcagucugccgagguuggcgcugcagaaaccacacugacugagcucagaagg

SEQ ID NO: 72290 - RNA, 27 nt, Artificial Sequence
  Dual specificity tyrosine-phosphorylation-regulated kinase 1A (471-479)
uacuaugcccugcagcacagcuucuuu

SEQ ID NO: 72291 - RNA, 27 nt, Artificial Sequence
  Cap-specific mRNAucleoside-2'-O-)-methyltransferase 1 (795-803)
uacuauggcagacuguucugggagugg

SEQ ID NO: 72292 - RNA, 27 nt, Artificial Sequence
  Motile sperm domain-containing protein 2 (174-182)
uacuaucccaaguaccugagcaaaauc

SEQ ID NO: 72293 - RNA, 27 nt, Artificial Sequence
  Procollagen-lysine,2-oxoglutarate 5-dioxygenase 2 (114-122)
uacuauaccaagggcuucgcccugcuc

SEQ ID NO: 72294 - RNA, 27 nt, Artificial Sequence
  Receptor-type protein tyrosine phosphatase beta (1197-1205)
uacuauaccgugagaaacuucacacug

SEQ ID NO: 72295 - RNA, 27 nt, Artificial Sequence
  CASP8 and FADD-like apoptosis regulator (367-375)
uacuauguguggcugcagcacacccuc

SEQ ID NO: 72296 - RNA, 27 nt, Artificial Sequence
  Tyrosine-protein kinase JAK1 (67-75)
gcccuguacgacgagaacaccaagcuc

SEQ ID NO: 72297 - RNA, 27 nt, Artificial Sequence
  RNA-binding protein 4 (259-267)
gccauggcuagccaccugaccuccaca

SEQ ID NO: 72298 - RNA, 27 nt, Artificial Sequence
  Neuroligin-3 (389-397)
gagggccugaaguucguggaagggguc

SEQ ID NO: 72299 - RNA, 27 nt, Artificial Sequence
  StAR-related lipid transfer protein 7, mitochondrial (235-243)
ggcaugcccgacuuccuggagaagcuc

SEQ ID NO: 72300 - RNA, 27 nt, Artificial Sequence
  Katanin p60 ATPase-containing subunit A1 (77-85)
aagcuggacagcaccccccucaaagcc

SEQ ID NO: 72301 - RNA, 27 nt, Artificial Sequence
  YrdC domain-containing protein, mitochondrial (184-192)
cagauguucgagggcccccuggcccuc

SEQ ID NO: 72302 - RNA, 27 nt, Artificial Sequence
  Protein FAM72C (114-122)
agacuggacagcaccggcgugaacguc

SEQ ID NO: 72303 - RNA, 33 nt, Artificial Sequence
  ATP-dependent RNA helicase DHX36 (643-653)
agacugauggaccccccuagcaacgaggccgug

SEQ ID NO: 72304 - RNA, 27 nt, Artificial Sequence
  Serine/arginine repetitive matrix protein 2 (2370-2378)
agaauggcccccgcucugagcggcgca

SEQ ID NO: 72305 - RNA, 27 nt, Artificial Sequence
  Nuclear receptor coactivator 1 (835-843)
agaauggacggcgccgugaccagcguc

SEQ ID NO: 72306 - RNA, 27 nt, Artificial Sequence
  Ethanolamine kinase 1 (232-240)
agacagcuggccaagauccacgcuauu

SEQ ID NO: 72307 - RNA, 27 nt, Artificial Sequence
  Clathrin heavy chain 1 (1039-1047)
agagugauggaguacaucaacaggcug

SEQ ID NO: 72308 - RNA, 27 nt, Artificial Sequence
  Large proline-rich protein BAG6 (530-538)
agccuggcccagaugguguccggccuc

SEQ ID NO: 72309 - RNA, 27 nt, Artificial Sequence
  Mediator of RNA polymerase II transcription subunit 8 (11-19)
agccuggacgcccuccuuucccaggug

SEQ ID NO: 72310 - RNA, 33 nt, Artificial Sequence
  Cathepsin L1 (247-257)
guggccaucgacgcuggccacgagagcuuccug

SEQ ID NO: 72311 - RNA, 27 nt, Artificial Sequence
  UDP-glucose:glycoprotein glucosyltransferase 2 (187-195)
uacgccgagaugggcaccagaacauuc

SEQ ID NO: 72312 - RNA, 30 nt, Artificial Sequence
  Alkyldihydroxyacetonephosphate synthase, peroxisomal (308-317)
agcaccgugggcgggugggucuccacaaga

SEQ ID NO: 72313 - RNA, 54 nt, Artificial Sequence
  Paired box protein Pax-2 (160-177)
gcccccggccacaccaucgugccuagcacagcuuccccaccggucucuucagca

SEQ ID NO: 72314 - RNA, 45 nt, Artificial Sequence
  Glutamyl aminopeptidase (290-304)
gccgugcaccaguucgacagcgucaagagaaucuccaacucuggc

SEQ ID NO: 72315 - RNA, 24 nt, Artificial Sequence
  Inositol 1,4,5-trisphosphate receptor type 3 (333-340)
gacauccugauuagaaccgagcuc

SEQ ID NO: 72316 - RNA, 27 nt, Artificial Sequence
  Fatty acid synthase (1644-1652)
gaggccgcuagcgugcccgucguuuac

SEQ ID NO: 72317 - RNA, 36 nt, Artificial Sequence
  POTE ankyrin domain family member E (1064-1075)
gagagcggccccuccaucgugcacagaaagugcuuc

SEQ ID NO: 72318 - RNA, 27 nt, Artificial Sequence
  Beta-1-syntrophin (163-171)
cuggccgaccccgagaacagacagcuc

SEQ ID NO: 72319 - RNA, 27 nt, Artificial Sequence
  Egl nine homolog 3 (194-202)
aacccccacgaggugcagccuagcuac

SEQ ID NO: 72320 - RNA, 24 nt, Artificial Sequence
  GRB2-related adapter protein (34-41)
cagaacugguacaaggccgagcug

SEQ ID NO: 72321 - RNA, 27 nt, Artificial Sequence
  Protein-lysine 6-oxidase (86-94)
cagcccagaaccccuauccugcucauu

SEQ ID NO: 72322 - RNA, 24 nt, Artificial Sequence
  Adenomatous polyposis coli protein (222-229)
cagcaaaucgagaaggacauucug

SEQ ID NO: 72323 - RNA, 27 nt, Artificial Sequence
  Insulin-like growth factor-binding protein 3 (5-13)
agacccacccugugggccgcugcacuc

SEQ ID NO: 72324 - RNA, 42 nt, Artificial Sequence
  Thrombospondin-1 (56-69)
agccccgccuucagaaucgaggacgcuaaccugauuccucca

SEQ ID NO: 72325 - RNA, 30 nt, Artificial Sequence
  Epidermal growth factor receptor (1026-1035)
agccccuccaccucuagaacaccucugcuc

SEQ ID NO: 72326 - RNA, 48 nt, Artificial Sequence
  Thrombospondin-2 (96-111)
agcagaggcacccugcucgcccuugaggggcccggacugucccagagg

SEQ ID NO: 72327 - RNA, 27 nt, Artificial Sequence
  Transforming growth factor beta-1 (263-271)
accccccuggagagagcccagcaccuc

SEQ ID NO: 72328 - RNA, 51 nt, Artificial Sequence
  Transforming growth factor-beta-induced protein ig-h3 (579-595)
gugagcggcgggaucggagcccuggucagacucaagucccuucagggugac

SEQ ID NO: 72329 - RNA, 30 nt, Artificial Sequence
  Matrilysin (167-176)
uaccccuucgacggcccugggaacacccug

SEQ ID NO: 72330 - RNA, 30 nt, Artificial Sequence
  Cytochrome b-c1 complex subunit Rieske, mitochondrial (82-91)
gacaucaaggugcccgauuucagcgaguac

SEQ ID NO: 72331 - RNA, 36 nt, Artificial Sequence
  Thioredoxin-related transmembrane protein 4 (92-103)
gacgugauccaggagcccggccugagcgggagauuc

SEQ ID NO: 72332 - RNA, 36 nt, Artificial Sequence
  Keratin, type I cytoskeletal 9 (29-40)
gaggaagccaacaaugaccuggagaacaagauccag

SEQ ID NO: 72333 - RNA, 42 nt, Artificial Sequence
  POTE ankyrin domain family member E (805-818)
cugaccgaggccccccucaacccuaaggcuaauagagaaaaa

SEQ ID NO: 72334 - RNA, 51 nt, Artificial Sequence
  POTE ankyrin domain family member E (805-821)
cugaccgaggccccccucaacccuaaggcuaauagagaaaaaaugacacag

SEQ ID NO: 72335 - RNA, 36 nt, Artificial Sequence
  40S ribosomal protein S21 (35-46)
aacguggccgaggucgacaagguuaccggcagauuc

SEQ ID NO: 72336 - RNA, 27 nt, Artificial Sequence
  Keratin, type II cytoskeletal 2 epidermal (170-178)
aacgugaaggucgaccccgagauccag

SEQ ID NO: 72337 - RNA, 54 nt, Artificial Sequence
  Heat shock protein beta-1 (188-205)
agagcccagcugggcgggcccgaggcugcaaagagcgacgaaaccgccgcgaaa

SEQ ID NO: 72338 - RNA, 33 nt, Artificial Sequence
  Actin, alpha skeletal muscle (2-12)
agagagaucgugagggacauuaaggaaaaacug

SEQ ID NO: 72339 - RNA, 42 nt, Artificial Sequence
  ATP synthase subunit gamma, mitochondrial (176-189)
agcggcuacgaguucgacgaaggguccaucauuuuuaacaag

SEQ ID NO: 72340 - RNA, 36 nt, Artificial Sequence
  Fibronectin (1340-1351)
agcguguacgagcagcacgaauccaccccccugaga

SEQ ID NO: 72341 - RNA, 48 nt, Artificial Sequence
  Vimentin (38-53)
uacagccugggcuccgcccucagacccucuaccucaaggagucuuuau

SEQ ID NO: 72342 - RNA, 27 nt, Artificial Sequence
  Guanylate kinase (10-18)
gccgcugcagcccugggcagagcgccc

SEQ ID NO: 72343 - RNA, 27 nt, Artificial Sequence
  T-box transcription factor TBX2 (59-67)
gccgcugcagaggccggccugcacgug

SEQ ID NO: 72344 - RNA, 36 nt, Artificial Sequence
  Heterogeneous nuclear ribonucleoprotein L (36-47)
gccgcugcaggcgggggagguggcgggggaagauac

SEQ ID NO: 72345 - RNA, 39 nt, Artificial Sequence
  Heterogeneous nuclear ribonucleoprotein L (36-48)
gccgcugcaggcgggggagguggcgggggaagauacuau

SEQ ID NO: 72346 - RNA, 24 nt, Artificial Sequence
  Exocyst complex component 4 (16-23)
gccgcugcacacagcgugguccug

SEQ ID NO: 72347 - RNA, 27 nt, Artificial Sequence
  Fumarate hydratase, mitochondrial (155-163)
gccgcugcaaucgaggugcacgaaguc

SEQ ID NO: 72348 - RNA, 27 nt, Artificial Sequence
  Calcium-binding mitochondrial carrier protein Aralar2 (2-10)
gccgcugcaaagguggcccugaccaaa

SEQ ID NO: 72349 - RNA, 27 nt, Artificial Sequence
  ATP-binding cassette sub-family B member 10, mitochondrial (226-234)
gccgcugcaaacgccaucagaguguac

SEQ ID NO: 72350 - RNA, 33 nt, Artificial Sequence
  Iroquois-class homeodomain protein IRX-2 (414-424)
gccgcugcacccggcgaggcccugcacaccgcg

SEQ ID NO: 72351 - RNA, 24 nt, Artificial Sequence
  Bcl-2-binding component 3 (195-202)
gccgcugcacccccucugacccuc

SEQ ID NO: 72352 - RNA, 27 nt, Artificial Sequence
  Polyadenylate-binding protein 4 (547-555)
gccgcugcacccccucaggagcaaaag

SEQ ID NO: 72353 - RNA, 27 nt, Artificial Sequence
  Protein Shroom2 (289-297)
gccgcugcacagcacuucaccgcccug

SEQ ID NO: 72354 - RNA, 27 nt, Artificial Sequence
  LRRN4 C-terminal-like protein (230-238)
gccgcugcaagagccgcgggcgcucug

SEQ ID NO: 72355 - RNA, 30 nt, Artificial Sequence
  Pyridoxal-dependent decarboxylase domain-containing protein 1 (179-188)
gccgcugcaagacccggccuggggcaguac

SEQ ID NO: 72356 - RNA, 27 nt, Artificial Sequence
  T-complex protein 1 subunit alpha (24-32)
gccgcugcaagcaucgccaacauugug

SEQ ID NO: 72357 - RNA, 27 nt, Artificial Sequence
  Neuronal pentraxin receptor (38-46)
gccgcugcaagccccggcccucagaga

SEQ ID NO: 72358 - RNA, 27 nt, Artificial Sequence
  Disco-interacting protein 2 homolog C (25-33)
gccgcugcaguggacgucagaaccugg

SEQ ID NO: 72359 - RNA, 33 nt, Artificial Sequence
  Tubulin beta-4B chain (10-20)
gccgcuugcgaccccagacacggcagguaccug

SEQ ID NO: 72360 - RNA, 27 nt, Artificial Sequence
  Cartilage-associated protein (245-253)
gccgcuugcgagggcagcagagaaauc

SEQ ID NO: 72361 - RNA, 27 nt, Artificial Sequence
  Phenylalanine-tRNA ligase alpha subunit (118-126)
gccgcugacggccccagaguguucagg

SEQ ID NO: 72362 - RNA, 27 nt, Artificial Sequence
  Importin-4 (48-56)
gccgcugacccccagaucagacaauuc

SEQ ID NO: 72363 - RNA, 24 nt, Artificial Sequence
  UBA-like domain-containing protein 1 (24-31)
gccgcugaccaggcaaagcaacug

SEQ ID NO: 72364 - RNA, 33 nt, Artificial Sequence
  Melanoma antigen preferentially expressed in tumors (59-69)
gccgcuuucgacggcagacacagccagacccug

SEQ ID NO: 72365 - RNA, 27 nt, Artificial Sequence
  Cleavage and polyadenylation specificity factor subunit 2 (121-129)
gccgcuuucgacaagauccagcaacug

SEQ ID NO: 72366 - RNA, 27 nt, Artificial Sequence
  Splicing factor 3B subunit 1 (744-752)
gccgcuuuccugaaggcaaucggcuac

SEQ ID NO: 72367 - RNA, 27 nt, Artificial Sequence
  V-type proton ATPase subunit H (287-295)
gccgcuuucagaaacuuucuggagaag

SEQ ID NO: 72368 - RNA, 27 nt, Artificial Sequence
  Macrophage-capping protein (134-142)
gccgcuaucaagaaacuguaccaggug

SEQ ID NO: 72369 - RNA, 27 nt, Artificial Sequence
  Ferritin heavy chain (81-89)
gccgcuaucaacagacagauuaaucug

SEQ ID NO: 72370 - RNA, 27 nt, Artificial Sequence
  Growth arrest-specific protein 8 (268-276)
gccgcuauccaggaggugcaacagaag

SEQ ID NO: 72371 - RNA, 27 nt, Artificial Sequence
  Malate dehydrogenase, cytoplasmic (114-122)
gccgcucuggacaaguacgcaaaaaag

SEQ ID NO: 72372 - RNA, 33 nt, Artificial Sequence
  Numb-like protein (541-551)
gccgcucuggagggcaaggcaaccguggaaaaa

SEQ ID NO: 72373 - RNA, 27 nt, Artificial Sequence
  Leucine-rich repeat-containing protein 41 (525-533)
gccgcuaugaagggcaacagcacccug

SEQ ID NO: 72374 - RNA, 30 nt, Artificial Sequence
  Alkyldihydroxyacetonephosphate synthase, peroxisomal (76-85)
gccgcucaggagagcggcaccauccccaag

SEQ ID NO: 72375 - RNA, 27 nt, Artificial Sequence
  HEAT repeat-containing protein 5B (541-549)
gccgcucagaacagcagacugucccuc

SEQ ID NO: 72376 - RNA, 27 nt, Artificial Sequence
  cAMP-dependent protein kinase type I-alpha regulatory subunit (7-15)
gccgcuagcgaggaagcaagaucccug

SEQ ID NO: 72377 - RNA, 27 nt, Artificial Sequence
  WD repeat-containing protein 54 (75-83)
gccgcuagcggccacuucaucugcgug

SEQ ID NO: 72378 - RNA, 27 nt, Artificial Sequence
  Sterol regulatory element-binding protein 2 (104-112)
gccgcuagcccccaggcaccuacccug

SEQ ID NO: 72379 - RNA, 27 nt, Artificial Sequence
  Vesicle transport through interaction with t-SNAREs homolog 1B (5-13)
gccgcuagcuccgagcacuucgaaaag

SEQ ID NO: 72380 - RNA, 27 nt, Artificial Sequence
  Actin, cytoplasmic 2 (21-29)
gccgcuagcuccucuucacuggagaag

SEQ ID NO: 72381 - RNA, 27 nt, Artificial Sequence
  Talin-1 (770-778)
gccgcuaccgcagugacacaggcccug

SEQ ID NO: 72382 - RNA, 27 nt, Artificial Sequence
  Serine/threonine-protein phosphatase 4 regulatory subunit 3B (382-390)
gccgcuaccgacaucuucagcuaccug

SEQ ID NO: 72383 - RNA, 27 nt, Artificial Sequence
  Long-chain fatty acid transport protein 1 (241-249)
gccgcuguggcagacccccacagccug

SEQ ID NO: 72384 - RNA, 27 nt, Artificial Sequence
  Bifunctional apoptosis regulator (156-164)
gccgcugugaaccccggcagaagccug

SEQ ID NO: 72385 - RNA, 33 nt, Artificial Sequence
  Ligand-dependent nuclear receptor-interacting factor 1 (176-186)
gccgcuuacgagcagagccacuucuuuaacaag

SEQ ID NO: 72386 - RNA, 27 nt, Artificial Sequence
  Drebrin (97-105)
gccugcgcuagccacguggcaaagguc

SEQ ID NO: 72387 - RNA, 27 nt, Artificial Sequence
  WASH complex subunit strumpellin (384-392)
gccugcgaccccaacaauaagagacug

SEQ ID NO: 72388 - RNA, 27 nt, Artificial Sequence
  Zinc finger protein 106 (941-949)
gccugccuggacaaguucgugagaguc

SEQ ID NO: 72389 - RNA, 33 nt, Artificial Sequence
  Fructose-bisphosphate aldolase A (33-43)
gccgacgagagcaccggcuccaucgcuaagaga

SEQ ID NO: 72390 - RNA, 33 nt, Artificial Sequence
  Selenoprotein N (53-63)
gccgaggcucaggcagccgcgagacaagaacug

SEQ ID NO: 72391 - RNA, 33 nt, Artificial Sequence
  Myosin-11 (2-12)
gccgaggcuagagaaaaggagaccaaagcacug

SEQ ID NO: 72392 - RNA, 27 nt, Artificial Sequence
  Tetratricopeptide repeat protein 37 (1248-1256)
gccgaggacgaaaagaacaccgcucug

SEQ ID NO: 72393 - RNA, 27 nt, Artificial Sequence
  Heat shock factor protein 1 (137-145)
gccgaggaccccaccaucagccugcuc

SEQ ID NO: 72394 - RNA, 30 nt, Artificial Sequence
  Melanoma antigen recognized by T-cells 1 (24-33)
gccgaggaagcugcaggcaucgggauucug

SEQ ID NO: 72395 - RNA, 27 nt, Artificial Sequence
  Protein SFI1 homolog (356-364)
gccgaggaaccccacgcucuggagcuc

SEQ ID NO: 72396 - RNA, 33 nt, Artificial Sequence; identical to SEQ ID NO: 48169
  Metalloproteinase inhibitor 2 (114-124)

SEQ ID NO: 72397 - RNA, 27 nt, Artificial Sequence
  T-complex protein 1 subunit zeta (326-334)
gccgagcacagcgaauccggccagcug

SEQ ID NO: 72398 - RNA, 33 nt, Artificial Sequence
  ALK tyrosine kinase receptor (403-413)
gccgagaucaagaccacaaacgaagugguccug

SEQ ID NO: 72399 - RNA, 33 nt, Artificial Sequence
  Junction plakoglobin (137-147)
gccgagcuggcuaccagagcacuccccgaacuu

SEQ ID NO: 72400 - RNA, 27 nt, Artificial Sequence
  E3 ubiquitin-protein ligase BRE1A (672-680)
gccgagcuggaagaccucagacagagg

SEQ ID NO: 72401 - RNA, 30 nt, Artificial Sequence
  Disheveled-associated activator of morphogenesis 2 (875-884)
gccgagcuggaaaaggaggugggcaaccuc

SEQ ID NO: 72402 - RNA, 30 nt, Artificial Sequence
  MAD2L1-binding protein (129-138)
gccgagcuggaaagcgugcucucccaccuu

SEQ ID NO: 72403 - RNA, 30 nt, Artificial Sequence
  Inactive ubiquitin carboxyl-terminal hydrolase 54 (1171-1180)
gccgagcccgacaucuaccaggaaaagcug

SEQ ID NO: 72404 - RNA, 33 nt, Artificial Sequence
  Stathmin-3 (108-118)
gccgagagaagggaacacgagcgggaagugcug

SEQ ID NO: 72405 - RNA, 24 nt, Artificial Sequence
  Cytoplasmic dynein 1 light intermediate chain 2 (86-93)
gccgagagccugcccgaaacccuc

SEQ ID NO: 72406 - RNA, 30 nt, Artificial Sequence
  Neurosecretory protein VGF (183-192)
gccgagaccgaaacaagaacucacacgcug

SEQ ID NO: 72407 - RNA, 27 nt, Artificial Sequence
  Gamma-interferon-inducible protein 16 (79-87)
gccgagacccugaagaaagaaaagcuc

SEQ ID NO: 72408 - RNA, 30 nt, Artificial Sequence
  Formin-binding protein 1-like (452-461)
gccgagaccaugaacaauaucgacagacug

SEQ ID NO: 72409 - RNA, 30 nt, Artificial Sequence
  Tumor susceptibility gene 101 protein (282-291)
gccgagguggacaagaacaucgaacugcuc

SEQ ID NO: 72410 - RNA, 27 nt, Artificial Sequence
  Consortin (611-619)
gccgaggugguccccaccgaaggccug

SEQ ID NO: 72411 - RNA, 27 nt, Artificial Sequence
  Nuclear mitotic apparatus protein 1 (857-865)
gccggcaucgagagccacuccgaacug

SEQ ID NO: 72412 - RNA, 27 nt, Artificial Sequence
  Nuclear receptor corepressor 2 (1168-1176)
gccggccccccugagagccugggggug

SEQ ID NO: 72413 - RNA, 33 nt, Artificial Sequence
  Hermansky-Pudlak syndrome 5 protein (284-294)
gccggcagcucccagucucugucauuccccaag

SEQ ID NO: 72414 - RNA, 27 nt, Artificial Sequence
  Actin-related protein 2/3 complex subunit 1B (24-32)
gccaucugccccaacaaucacgaggug

SEQ ID NO: 72415 - RNA, 42 nt, Artificial Sequence
  Syndecan-3 (292-305)
gccaucgacagcggcuccucugcugcacagcugccccaaaag

SEQ ID NO: 72416 - RNA, 27 nt, Artificial Sequence
  Ewing's tumor-associated antigen 1 (284-292)
gccaucuucgacggcagcacccagaag

SEQ ID NO: 72417 - RNA, 33 nt, Artificial Sequence
  Tectonic-3 (478-488)
gccaucuucggcaacgcugaccccgcacagaag

SEQ ID NO: 72418 - RNA, 27 nt, Artificial Sequence
  Kinesin-like protein KIF20B (640-648)
gccaucuucaaggaccuggugggcaaa

SEQ ID NO: 72419 - RNA, 27 nt, Artificial Sequence
  Rho-related GTP-binding protein RhoQ (186-194)
gccaucauugcuauacugacccccaag

SEQ ID NO: 72420 - RNA, 27 nt, Artificial Sequence
  Protein wntless homolog (4-12)
gccaucauugagaacaugagcaccaag

SEQ ID NO: 72421 - RNA, 27 nt, Artificial Sequence
  Eukaryotic translation initiation factor 3 subunit C-like protein (482-490)
gccaucauugagagagugcagagguac

SEQ ID NO: 72422 - RNA, 33 nt, Artificial Sequence
  40S ribosomal protein S17 (39-49)
gccaucauucccagcaagaaacugagaaacaag

SEQ ID NO: 72423 - RNA, 30 nt, Artificial Sequence; identical to SEQ ID NO: 48196
  Ribulose-phosphate 3-epimerase (118-127)

SEQ ID NO: 72424 - RNA, 33 nt, Artificial Sequence
  Serine/threonine-protein kinase Sgk1 (47-57)
gccaucaagcccccucugaaagcuuucaugaag

SEQ ID NO: 72425 - RNA, 27 nt, Artificial Sequence
  NF-kappa-B inhibitor beta (102-110)
gccauccugggcgagaccagcacagug

SEQ ID NO: 72426 - RNA, 30 nt, Artificial Sequence
  GTP-binding protein Rheb (10-19)
gccauccugggcuacagaagcguggggaag

SEQ ID NO: 72427 - RNA, 33 nt, Artificial Sequence
  Fibroblast growth factor 14 isoform 6 (201-211)
gccaucaugaacggcgggaagcccgugaauaaa

SEQ ID NO: 72428 - RNA, 27 nt, Artificial Sequence
  Puratrophin-1 (1020-1028)
gccaucaacgacagaaccgugaauuac

SEQ ID NO: 72429 - RNA, 27 nt, Artificial Sequence
  Mitotic spindle assembly checkpoint protein MAD2A (123-131)
gccauccaggacgagauuagaagcgug

SEQ ID NO: 72430 - RNA, 27 nt, Artificial Sequence
  Radixin (19-27)
gccauccagcccaacaccacaggcaag

SEQ ID NO: 72431 - RNA, 33 nt, Artificial Sequence
  ATP-dependent 6-phosphofructokinase, platelet type (229-239)
gccaucuacgacggcuucgauggguuugcuaag

SEQ ID NO: 72432 - RNA, 39 nt, Artificial Sequence
  Cytochrome b-c1 complex subunit 9 (42-54)
gccaucuacgaccacauuaacgagggcaagcuguggaaa

SEQ ID NO: 72433 - RNA, 36 nt, Artificial Sequence
  Transcription initiation factor IIB (257-268)
gccaucuacauggcuagccaggcauccgccgagaag

SEQ ID NO: 72434 - RNA, 27 nt, Artificial Sequence
  Serine dehydratase-like (282-290)
gccaucuacagcggccugcucagaagg

SEQ ID NO: 72435 - RNA, 39 nt, Artificial Sequence
  Keratin, type II cytoskeletal 1 (303-315)
gccaagcuggacaaccuccagcaagagaucgauuuccuu

SEQ ID NO: 72436 - RNA, 24 nt, Artificial Sequence
  Kv channel-interacting protein 2 (72-79)
gcccuggcugcacccgccagccuc

SEQ ID NO: 72437 - RNA, 27 nt, Artificial Sequence
  GPI ethanolamine phosphate transferase 3 (917-925)
gcccuggcugcaagcauccucagaagg

SEQ ID NO: 72438 - RNA, 33 nt, Artificial Sequence
  Core histone macro-H2A.1 (296-306)
gcccuggcugacgauaagaaacucaagagcauc

SEQ ID NO: 72439 - RNA, 33 nt, Artificial Sequence
  Phosphatidylinositol 3-kinase regulatory subunit beta (169-179)
gcccuggcugacggcaucaagagcuuccuccuu

SEQ ID NO: 72440 - RNA, 33 nt, Artificial Sequence
  Basement membrane-specific heparan sulfate proteoglycan core protein (1484-1494)
gcccuggcugaccucgaugagcuucugaucaga

SEQ ID NO: 72441 - RNA, 33 nt, Artificial Sequence
  Protein SHQ1 homolog (400-410)
gcccuggcugaggcacucaaggaagugagccuu

SEQ ID NO: 72442 - RNA, 33 nt, Artificial Sequence
  Tropomodulin-1 (243-253)
gcccuggcugagaugcucaaggaaaacaaagug

SEQ ID NO: 72443 - RNA, 30 nt, Artificial Sequence
  Beta-1,4-glucuronyltransferase 1 (66-75)
gcccuggcuagcggcggggugcucgacgca

SEQ ID NO: 72444 - RNA, 27 nt, Artificial Sequence
  Zinc finger FYVE domain-containing protein 16 (1461-1469)
gcccugugcccccaccucaagacccuu

SEQ ID NO: 72445 - RNA, 27 nt, Artificial Sequence
  V-type proton ATPase subunit F (77-85)
gcccuggacgcucaccagcaaagcauc

SEQ ID NO: 72446 - RNA, 27 nt, Artificial Sequence
  17-beta-hydroxysteroid dehydrogenase 14 (169-177)
gcccuggacgagagccccuacggcgug

SEQ ID NO: 72447 - RNA, 33 nt, Artificial Sequence
  17-beta-hydroxysteroid dehydrogenase 14 (169-179)
gcccuggacgagagccccuacggcgugagaguc

SEQ ID NO: 72448 - RNA, 27 nt, Artificial Sequence
  Arf-GAP with SH3 domain, ANK repeat and PH domain-containing protein 1 (493-501)
gcccuggacaucgcuaagagacucaaa

SEQ ID NO: 72449 - RNA, 27 nt, Artificial Sequence
  TATA box-binding protein-like protein 1 (8-16)
gcccuggacauccucauuaccaacgug

SEQ ID NO: 72450 - RNA, 27 nt, Artificial Sequence
  Glutaminyl-peptide cyclotransferase (173-181)
gcccuggacaagaaacuccuuagccug

SEQ ID NO: 72451 - RNA, 33 nt, Artificial Sequence
  Pre-mRNA-processing factor 17 (138-148)
gcccuggaccccagccucgauaaccaccaggug

SEQ ID NO: 72452 - RNA, 33 nt, Artificial Sequence
  60S ribosomal protein L7a (86-96)
gcccuggacagacagaccgcuacacaacuccuu

SEQ ID NO: 72453 - RNA, 33 nt, Artificial Sequence
  Chromodomain-helicase-DNA-binding protein 1-like (822-832)
gcccuggaggaaggccucaagaaaaucuuccuu

SEQ ID NO: 72454 - RNA, 30 nt, Artificial Sequence
  Keratin, type I cytoskeletal 10 (217-226)
gcccuggaggaacagcuccaacagaucaga

SEQ ID NO: 72455 - RNA, 27 nt, Artificial Sequence
  Ribonuclease pancreatic (2-10)
gcccuggagaagagccucgugagacuu

SEQ ID NO: 72456 - RNA, 33 nt, Artificial Sequence
  Ribonuclease pancreatic (2-12)
gcccuggagaagagccucgugagacuucuguug

SEQ ID NO: 72457 - RNA, 39 nt, Artificial Sequence
  NADPH oxidase 5 (49-61)
gcccuguucgacagcgauagauccggcaccaucacacuc

SEQ ID NO: 72458 - RNA, 33 nt, Artificial Sequence; identical to SEQ ID NO: 48231
  Ankyrin repeat and SAM domain-containing protein 1A (255-265)

SEQ ID NO: 72459 - RNA, 36 nt, Artificial Sequence
  Alpha-1,6-mannosylglycoprotein 6-beta-N-acetylglucosaminyltransferase A (2-13)
gcccuguucacccccuggaagcucagcucccagaaa

SEQ ID NO: 72460 - RNA, 33 nt, Artificial Sequence
  Cell division cycle protein 16 homolog (22-32)
gcccuguucugggcugacaagguggcaagccuc

SEQ ID NO: 72461 - RNA, 27 nt, Artificial Sequence
  Cleft lip and palate transmembrane protein 1 (123-131)
gcccuguucugggagcagcacgaccuc

SEQ ID NO: 72462 - RNA, 36 nt, Artificial Sequence
  Ras-related protein Rab-27A (14-25)
gcccugggcgacagcggggugggaaagaccuccguc

SEQ ID NO: 72463 - RNA, 27 nt, Artificial Sequence
  Membrane-associated transporter protein (129-137)
gcccugaucgcuaaccccagaaggaag

SEQ ID NO: 72464 - RNA, 36 nt, Artificial Sequence
  E3 ubiquitin-protein ligase CBL-B (341-352)
gcccugaucgacggcagcagagagggguucuaccuc

SEQ ID NO: 72465 - RNA, 30 nt, Artificial Sequence
  Polypyrimidine tract-binding protein 1 (173-182)
gcccugaucgaccuccacaaccaugaucuu

SEQ ID NO: 72466 - RNA, 27 nt, Artificial Sequence
  Protein S100-B (10-18)
gcccugaucgacguguuccaccaguac

SEQ ID NO: 72467 - RNA, 33 nt, Artificial Sequence; identical to SEQ ID NO: 48240
  Melanoma-associated antigen C2 (196-206)

SEQ ID NO: 72468 - RNA, 30 nt, Artificial Sequence
  Coatomer subunit zeta-1 (3-12)
gcccugauccucgagcccagccuuuacacc

SEQ ID NO: 72469 - RNA, 27 nt, Artificial Sequence
  S-adenosylmethionine synthase isoform type-2 (221-229)
gcccugaaggagaaagugaucaaggcu

SEQ ID NO: 72470 - RNA, 30 nt, Artificial Sequence; identical to SEQ ID NO: 48243
  Zinc finger protein 318 (262-271)

SEQ ID NO: 72471 - RNA, 27 nt, Artificial Sequence
  Spliceosome-associated protein CWC15 homolog (128-136)
gcccugcucgcugagcuugaaaagauc

SEQ ID NO: 72472 - RNA, 21 nt, Artificial Sequence
  Protein DGCR6L (54-60)
gcccugcucgacggcaccgug

SEQ ID NO: 72473 - RNA, 36 nt, Artificial Sequence
  Eukaryotic translation initiation factor 3 subunit C-like protein (633-644)
gcccugcucgacauccagagcuccggcagagcuaag

SEQ ID NO: 72474 - RNA, 36 nt, Artificial Sequence
  Neural Wiskott-Aldrich syndrome protein (408-419)
gcccugcucgaccagaucagagagggcgcucaacuu

SEQ ID NO: 72475 - RNA, 36 nt, Artificial Sequence
  Wiskott-Aldrich syndrome protein (433-444)
gcccugcucgaccagaucagacaaggcauucagcuu

SEQ ID NO: 72476 - RNA, 33 nt, Artificial Sequence
  Serine/threonine-protein kinase PRP4 homolog (104-114)
gcccugcucgaggaccuugaaaagcagagagcu

SEQ ID NO: 72477 - RNA, 30 nt, Artificial Sequence
  Melanoma antigen preferentially expressed in tumors (371-380)
gcccugcucgagagagcuagcgcaacccuu

SEQ ID NO: 72478 - RNA, 30 nt, Artificial Sequence
  Cleft lip and palate transmembrane protein 1 (348-357)
gcccugcucgagaccaaccccuaccuucug

SEQ ID NO: 72479 - RNA, 45 nt, Artificial Sequence
  Proteasome subunit alpha type-7 (194-208)
gcccugcucgaggugguccagagcggcgggaagaacaucgaacuu

SEQ ID NO: 72480 - RNA, 30 nt, Artificial Sequence
  Ankyrin repeat domain-containing protein 17 (368-377)
gcccugcucaucgagagaggcgcuagccuu

SEQ ID NO: 72481 - RNA, 27 nt, Artificial Sequence
  Down syndrome critical region protein 3 (171-179)
gcccugcuccccaaguuccuucugaga

SEQ ID NO: 72482 - RNA, 27 nt, Artificial Sequence
  Melanoma antigen preferentially expressed in tumors (397-405)
gcccugcuccccagccuuucccacugc

SEQ ID NO: 72483 - RNA, 27 nt, Artificial Sequence
  Neuronal membraneoprotein M6-b (96-104)
gcccugcucagcgaggugauccagcuu

SEQ ID NO: 72484 - RNA, 27 nt, Artificial Sequence
  Ragulator complex protein LAMTOR1 (52-60)
gcccugcucagcuccauccuugcuaag

SEQ ID NO: 72485 - RNA, 27 nt, Artificial Sequence
  Sulfate transporter (523-531)
gcccugcucagcaccgagaucggccuu

SEQ ID NO: 72486 - RNA, 30 nt, Artificial Sequence
  Activator of 90 kDa heat shock protein ATPase homolog 1 (58-67)
gcccugaugaaggaggaaggcgugaaacuc

SEQ ID NO: 72487 - RNA, 27 nt, Artificial Sequence
  rRNA 2'-O-methyltransferase fibrillarin (244-252)
gcccugaacgcucacaccuuccucaga

SEQ ID NO: 72488 - RNA, 33 nt, Artificial Sequence
  Catenin alpha-1 (363-373)
gcccugaacagcgcuaucgacaagaugaccaaa

SEQ ID NO: 72489 - RNA, 27 nt, Artificial Sequence
  Cytoglobin (88-96)
gcccugaacaccguggucgagaaucuc

SEQ ID NO: 72490 - RNA, 27 nt, Artificial Sequence
  Growth/differentiation factor 15 (96-104)
gcccugcccgagggccucccugaagcu

SEQ ID NO: 72491 - RNA, 27 nt, Artificial Sequence
  Homer protein homolog 3 (191-199)
gcccugcaggacagcaacaauaagcuc

SEQ ID NO: 72492 - RNA, 33 nt, Artificial Sequence
  Metastasis suppressor protein 1 (165-175)
gcccugcaggacgugaacgauaaguaccuccuu

SEQ ID NO: 72493 - RNA, 27 nt, Artificial Sequence
  1-acyl-sn-glycerol-3-phosphate acyltransferase gamma (283-291)
gcccugcaggagaucuacaaccaaaag

SEQ ID NO: 72494 - RNA, 30 nt, Artificial Sequence
  Neuralized-like protein 4 (559-568)
gcccugagagacggcgagguguuccagguc

SEQ ID NO: 72495 - RNA, 27 nt, Artificial Sequence
  Neurosecretory protein VGF (3-11)
gcccugagacucagcgcuuccgcacuu

SEQ ID NO: 72496 - RNA, 27 nt, Artificial Sequence
  Dystonin (375-383)
gcccugagacccgagguggaaaggcuc

SEQ ID NO: 72497 - RNA, 36 nt, Artificial Sequence
  Vimentin (308-319)
gcccugagacaggcuaagcaagagagcaccgaauac

SEQ ID NO: 72498 - RNA, 27 nt, Artificial Sequence
  Coiled-coil domain-containing protein 154 (502-510)
gcccugagacaggagcucgcuacccuu

SEQ ID NO: 72499 - RNA, 45 nt, Artificial Sequence
  60S ribosomal protein L36 (2-16)
gcccugagauaccccauggcugugggccucaacaaggggcacaaa

SEQ ID NO: 72500 - RNA, 30 nt, Artificial Sequence; identical to SEQ ID NO: 48273
  Integrin alpha-V (893-902)

SEQ ID NO: 72501 - RNA, 27 nt, Artificial Sequence
  Kinesin-like protein KIF20B (1148-1156)
gcccugagcgagcucacccagggcgug

SEQ ID NO: 72502 - RNA, 27 nt, Artificial Sequence
  Ankycorbin (690-698)
gcccugagcgagaugaagucccaguac

SEQ ID NO: 72503 - RNA, 27 nt, Artificial Sequence
  Lysine-specific demethylase 5A (119-127)
gcccugagcaagaucguggcuuccaaa

SEQ ID NO: 72504 - RNA, 27 nt, Artificial Sequence
  Probable phospholipid-transporting ATPase IIA (685-693)
gcccugagccaguucgugauccacaga

SEQ ID NO: 72505 - RNA, 27 nt, Artificial Sequence
  Chondroitin sulfate proteoglycan 4 (45-53)
gcccugaccgacaucgaucuccagcuu

SEQ ID NO: 72506 - RNA, 27 nt, Artificial Sequence
  HRAS-like suppressor 3 (84-92)
gcccugaccgacaaggcuaucgugaaa

SEQ ID NO: 72507 - RNA, 27 nt, Artificial Sequence
  Neuroblastoma breakpoint family member 6 (396-404)
gcccugguggacaagaucaaaaaggau

SEQ ID NO: 72508 - RNA, 30 nt, Artificial Sequence
  Glycosylphosphatidylinositol anchor attachment 1 protein (38-47)
gcccugguguuccccccucucacccagaga

SEQ ID NO: 72509 - RNA, 36 nt, Artificial Sequence
  Nuclear nucleic acid-binding protein C1D (121-132)
gcccugugggagcccaagagcaaaaacgcuuccaag

SEQ ID NO: 72510 - RNA, 27 nt, Artificial Sequence
  Separin (752-760)
gcccuguggaaggagcuccuuaccaaa

SEQ ID NO: 72511 - RNA, 27 nt, Artificial Sequence
  Fucose mutarotase (91-99)
gcccuguacggcaaccucauccuuaga

SEQ ID NO: 72512 - RNA, 27 nt, Artificial Sequence
  Proteasome subunit beta type-4 (6-14)
gcccuguacagaggccccaucaccagg

SEQ ID NO: 72513 - RNA, 27 nt, Artificial Sequence
  Mitofusin-2 (433-441)
gccauggcugaggaaaucagaaggcug

SEQ ID NO: 72514 - RNA, 33 nt, Artificial Sequence
  Methionine synthase (1208-1218)
gccauggcucccgcaagcgccguguccggccug

SEQ ID NO: 72515 - RNA, 27 nt, Artificial Sequence
  Basement membrane-specific heparan sulfate proteoglycan core protein (3206-3214)
gccauggcucccggcgcaccucaggug

SEQ ID NO: 72516 - RNA, 30 nt, Artificial Sequence
  Unconventional myosin-IXa (1913-1922)
gccauggacgauggcaagagcaucagauac

SEQ ID NO: 72517 - RNA, 33 nt, Artificial Sequence
  Ubiquitin carboxyl-terminal hydrolase 4 (692-702)
gccauggacugggauagcgagaccagaaggcug

SEQ ID NO: 72518 - RNA, 30 nt, Artificial Sequence
  Myosin regulatory light polypeptide 9 (24-33)
gccauguucgaccagagccaaauccaggag

SEQ ID NO: 72519 - RNA, 36 nt, Artificial Sequence
  Eukaryotic translation initiation factor 3 subunit K (2-13)
gccauguucgagcagaugagagcuaacgugggcaag

SEQ ID NO: 72520 - RNA, 36 nt, Artificial Sequence; identical to SEQ ID NO: 48293
  Exportin-4 (248-259)

SEQ ID NO: 72521 - RNA, 27 nt, Artificial Sequence
  Ankyrin repeat domain-containing protein SOWAHC (349-357)
gccaugcacggccauguggaggucguu

SEQ ID NO: 72522 - RNA, 27 nt, Artificial Sequence
  Calpain-7 (409-417)
gccaugcacagcgacucccagaccuuc

SEQ ID NO: 72523 - RNA, 27 nt, Artificial Sequence
  Cytoplasmic FMR1-interacting protein 1 (490-498)
gccaugaucaagggccugcaggugcuc

SEQ ID NO: 72524 - RNA, 27 nt, Artificial Sequence
  DNA repair protein RAD50 (657-665)
gccaugcuggcuggcgcaaccgccgug

SEQ ID NO: 72525 - RNA, 36 nt, Artificial Sequence
  Melanocyte protein PMEL (184-195)
gccaugcugggcacccacacaauggaggugacuguc

SEQ ID NO: 72526 - RNA, 24 nt, Artificial Sequence
  Protein AAR2 homolog (287-294)
gccaugaugaagcaccauacccug

SEQ ID NO: 72527 - RNA, 33 nt, Artificial Sequence
  Atherin (156-166)
gccaugaacaaggagggcgggaccgcuagcgug

SEQ ID NO: 72528 - RNA, 30 nt, Artificial Sequence
  Guanine nucleotide-binding protein G(s) subunit alpha isoforms short (95-104)
gccaugagcaaccuggugcccccugucgag

SEQ ID NO: 72529 - RNA, 30 nt, Artificial Sequence
  Ubiquitin-conjugating enzyme E2 H (97-106)
gccauguaccugcacagacccgaggaauau

SEQ ID NO: 72530 - RNA, 36 nt, Artificial Sequence
  Copine-1 (72-83)
gcccaggcugcacaccaaggcaccgccagccaguac

SEQ ID NO: 72531 - RNA, 33 nt, Artificial Sequence
  Copine-1 (403-413)
gcccaggcugcacaccaaggcaccgccagcuac

SEQ ID NO: 72532 - RNA, 30 nt, Artificial Sequence
  Fatty acid synthase (1283-1292)
gcccaggcugagcugcaacagcacgacgug

SEQ ID NO: 72533 - RNA, 27 nt, Artificial Sequence
  Catenin beta-1 (702-710)
gcccagggcgagccccugggguacaga

SEQ ID NO: 72534 - RNA, 27 nt, Artificial Sequence
  Protein tyrosine phosphatase type IVA 1 (36-44)
gcccagcacgaccuguacgcugauaag

SEQ ID NO: 72535 - RNA, 24 nt, Artificial Sequence
  Glutathione S-transferase A4 (32-39)
gcccagaaggcuaucauuagauac

SEQ ID NO: 72536 - RNA, 27 nt, Artificial Sequence
  Patatin-like phospholipase domain-containing protein 7 (872-880)
gcccagaagcaacugauccuccuucac

SEQ ID NO: 72537 - RNA, 27 nt, Artificial Sequence
  Vigilin (548-556)
gcccagaagagcgacaucgugcaacug

SEQ ID NO: 72538 - RNA, 24 nt, Artificial Sequence
  CD276 antigen (61-68)
gcccagcugaaccucaucuggcaa

SEQ ID NO: 72539 - RNA, 30 nt, Artificial Sequence
  Zinc finger protein 507 (116-125)
gcccagaacgagggcaaggcuaugagcuac

SEQ ID NO: 72540 - RNA, 27 nt, Artificial Sequence
  Hemicentin-1 (4060-4068)
gcccagaaccccgcuggcaccgcacug

SEQ ID NO: 72541 - RNA, 27 nt, Artificial Sequence
  NAD(P) transhydrogenase, mitochondrial (158-166)
gcccagaaccccgagcugcucaauaag

SEQ ID NO: 72542 - RNA, 27 nt, Artificial Sequence
  Elongator complex protein 2 (42-50)
gcccagcaaaacgaccaguuccagaag

SEQ ID NO: 72543 - RNA, 27 nt, Artificial Sequence
  Microphthalmia-associated transcription factor (118-126)
gcccagagacaacaggugaagcaguac

SEQ ID NO: 72544 - RNA, 27 nt, Artificial Sequence
  Cytoplasmic polyadenylation element-binding protein 1 (45-53)
gcccagagcuccacccacucugugcug

SEQ ID NO: 72545 - RNA, 27 nt, Artificial Sequence
  GMP synthase (glutamine-hydrolyzing) (130-138)
gcccaguacggcaaggugaucgacaga

SEQ ID NO: 72546 - RNA, 27 nt, Artificial Sequence
  1,2-dihydroxy-3-keto-5-methylthiopentene dioxygenase (181-189)
gccagaggccaguacgugaaguuccug

SEQ ID NO: 72547 - RNA, 27 nt, Artificial Sequence
  Ankyrin repeat and LEM domain-containing protein 2 (211-219)
gccagaaacgagaggaucuacguguau

SEQ ID NO: 72548 - RNA, 27 nt, Artificial Sequence
  Dolichyl-diphosphooligosaccharide-proteinosyltransferase subunit 2 (256-264)
gccagcgcugcagccgugcugucccac

SEQ ID NO: 72549 - RNA, 30 nt, Artificial Sequence
  Probable RNA-binding protein 19 (488-497)
gccagcgcucugggcuccucuucauacaag

SEQ ID NO: 72550 - RNA, 27 nt, Artificial Sequence
  E3 ubiquitin-protein ligase MSL2 (294-302)
gccagcgcucccgugaccgucaagaga

SEQ ID NO: 72551 - RNA, 27 nt, Artificial Sequence
  Gelsolin (362-370)
gccagcgacuucaucaccaagauggau

SEQ ID NO: 72552 - RNA, 33 nt, Artificial Sequence
  Transient receptor potential cation channel subfamily M member 1 (215-225)
gccagcgacauccuguccuucgcucacaaguac

SEQ ID NO: 72553 - RNA, 30 nt, Artificial Sequence
  Suppressor of IKBKE 1 (58-67)
gccagcgacaugaaggauauguccaaauac

SEQ ID NO: 72554 - RNA, 30 nt, Artificial Sequence
  FERM domain-containing protein 4A (516-525)
gccagcgaccccaacguguccaagaaacug

SEQ ID NO: 72555 - RNA, 33 nt, Artificial Sequence
  FERM domain-containing protein 4A (483-493)
gccagcgaccccaacguguccaagaaacugaag

SEQ ID NO: 72556 - RNA, 30 nt, Artificial Sequence
  Centrosomal protein of 68 kDa (12-21)
gccagcgaggacaccaaggcucaguccuac

SEQ ID NO: 72557 - RNA, 30 nt, Artificial Sequence
  Nucleoside diphosphate kinase (158-167)
gccagcgaggaacaccugaagcagcauuac

SEQ ID NO: 72558 - RNA, 36 nt, Artificial Sequence
  Unconventional myosin-Ic (842-853)
gccagcgagaucuucaagggcaaaaaggacaacuac

SEQ ID NO: 72559 - RNA, 33 nt, Artificial Sequence
  Amino-terminal enhancer of split (51-61)
gccagcgagaaguccgaaaugcagagacacuac

SEQ ID NO: 72560 - RNA, 27 nt, Artificial Sequence
  Retinal dehydrogenase 1 (82-90)
gccagcgagagaggcaggcugcucuac

SEQ ID NO: 72561 - RNA, 30 nt, Artificial Sequence
  Macrophage metalloelastase (13-22)
gccagcggcgcucugccccucaacuccucu

SEQ ID NO: 72562 - RNA, 33 nt, Artificial Sequence
  Nuclear factor interleukin-3-regulated protein (14-24)
gccagccuggacgcuuccucuaacguggauaag

SEQ ID NO: 72563 - RNA, 33 nt, Artificial Sequence
  Melanocyte protein PMEL (619-629)
gccagccugaucuacagaaggcggcucaugaag

SEQ ID NO: 72564 - RNA, 33 nt, Artificial Sequence
  SH2B adapter protein 3 (209-219)
gccagcauggacuccggcgcuagauggcagagg

SEQ ID NO: 72565 - RNA, 30 nt, Artificial Sequence
  Protein argonaute-1 (168-177)
gccagcaugagauacacccccgugggcagg

SEQ ID NO: 72566 - RNA, 27 nt, Artificial Sequence
  5'-3' exoribonuclease 2 (454-462)
gccagcaaccccagacaggcugcauac

SEQ ID NO: 72567 - RNA, 45 nt, Artificial Sequence
  PERQ amino acid-rich with GYF domain-containing protein 2 (1277-1291)
gccagcuccgagagacugaacaugggcgaaaucgagacccucgac

SEQ ID NO: 72568 - RNA, 48 nt, Artificial Sequence
  PERQ amino acid-rich with GYF domain-containing protein 2 (1277-1292)
gccagcuccgagagacugaacaugggcgaaaucgagacccucgacgau

SEQ ID NO: 72569 - RNA, 51 nt, Artificial Sequence
  PERQ amino acid-rich with GYF domain-containing protein 2 (1277-1293)
gccagcuccgagagacugaacaugggcgaaaucgagacccucgacgauuac

SEQ ID NO: 72570 - RNA, 54 nt, Artificial Sequence
  Vimentin (54-71)
gccagcucccccggcgggguguacgcuaccagaucuucagcagucaggcugcgg

SEQ ID NO: 72571 - RNA, 42 nt, Artificial Sequence
  Chondroitin sulfate proteoglycan 4 (1607-1620)
gccagcuccucugcuggcaccgacccccagcugcuccuuuac

SEQ ID NO: 72572 - RNA, 27 nt, Artificial Sequence
  Contactin-associated protein-like 3B (2-10)
gccagcguggcuugggcaguccugaag

SEQ ID NO: 72573 - RNA, 27 nt, Artificial Sequence
  Sister chromatid cohesion protein PDS5 homolog B (520-528)
gccagcgugaaggcuaucuucuccaaa

SEQ ID NO: 72574 - RNA, 45 nt, Artificial Sequence
  RNA-binding protein 14 (526-540)
gccagcuacgcugcacagcaacacccccaggccgcggcuuccuau

SEQ ID NO: 72575 - RNA, 33 nt, Artificial Sequence
  N6-adenosine-methyltransferase subunit METTL14 (53-63)
gccagcuacgacaccuccgcucccaacgcaaag

SEQ ID NO: 72576 - RNA, 30 nt, Artificial Sequence
  Origin recognition complex subunit 5 (316-325)
gccagcuacaaccccgcuagaaccgacaag

SEQ ID NO: 72577 - RNA, 36 nt, Artificial Sequence
  SPRY domain-containing SOCS box protein 1 (216-227)
gccaccgcugacgcaccccugcacagcgugggcuac

SEQ ID NO: 72578 - RNA, 27 nt, Artificial Sequence
  Laminin subunit beta-2 (265-273)
gccaccgcugaccuggcacucggcaga

SEQ ID NO: 72579 - RNA, 30 nt, Artificial Sequence
  Oxidative stress-induced growth inhibitor 1 (253-262)
gccaccgcuggcgacaucgcacacuacuau

SEQ ID NO: 72580 - RNA, 27 nt, Artificial Sequence
  Uncharacterized protein KIAA0355 (675-683)
gccaccgcuauggugacagagcagaag

SEQ ID NO: 72581 - RNA, 27 nt, Artificial Sequence
  E1A-binding protein p400 (1093-1101)
gccaccgcucaggugguccaacagaag

SEQ ID NO: 72582 - RNA, 33 nt, Artificial Sequence
  Huntingtin-interacting protein 1 (499-509)
gccaccgcuagaaucgaggaaaugcugagcaag

SEQ ID NO: 72583 - RNA, 36 nt, Artificial Sequence
  Coatomer subunit beta' (703-714)
gccaccgcuagcggcaacgcaaauauggugaacaag

SEQ ID NO: 72584 - RNA, 30 nt, Artificial Sequence
  Vacuolar protein sorting-associated protein 18 homolog (854-863)
gccaccugcgacuucccccugcucaacaga

SEQ ID NO: 72585 - RNA, 24 nt, Artificial Sequence
  PH domain leucine-rich repeat-containing protein phosphatase 1 (536-543)
gccaccgacgcuccccugagaaag

SEQ ID NO: 72586 - RNA, 27 nt, Artificial Sequence
  Myomegalin (2167-2175)
gccaccgacggcagcuucgcuaacaag

SEQ ID NO: 72587 - RNA, 33 nt, Artificial Sequence
  Slit homolog 3 protein (1187-1197)
gccaccgacaaggauaacggcauccugcucuac

SEQ ID NO: 72588 - RNA, 33 nt, Artificial Sequence
  Protocadherin Fat 2 (739-749)
gccaccgaccccgaugcuggcuucaacgggaag

SEQ ID NO: 72589 - RNA, 33 nt, Artificial Sequence
  DNA-dependent protein kinase catalytic subunit (4080-4090)
gccaccgaccccaacauccugggcagaacaugg

SEQ ID NO: 72590 - RNA, 30 nt, Artificial Sequence
  Apolipoprotein D (122-131)
gccaccgacuacgagaacuaugcucuggug

SEQ ID NO: 72591 - RNA, 33 nt, Artificial Sequence
  Apolipoprotein D (122-132)
gccaccgacuacgagaacuaugcucugguguac

SEQ ID NO: 72592 - RNA, 27 nt, Artificial Sequence
  Semaphorin-5A (423-431)
gccaccgacuacggcacaaucaagaaa

SEQ ID NO: 72593 - RNA, 21 nt, Artificial Sequence
  Fibronectin type III domain-containing protein 3B (348-354)
gccaccgacuaccacgugaga

SEQ ID NO: 72594 - RNA, 33 nt, Artificial Sequence
  Zinc finger MYM-type protein 3 (76-86)
gccaccgagcugcucggccuugggggacuguug

SEQ ID NO: 72595 - RNA, 27 nt, Artificial Sequence
  B-cell CLL/lymphoma 9 protein (163-171)
gccaccgagcccacaccugcucagaag

SEQ ID NO: 72596 - RNA, 33 nt, Artificial Sequence
  Ribosome-binding protein 1 (277-287)
gccaccgagcaggaagacgcugcaguggccaag

SEQ ID NO: 72597 - RNA, 39 nt, Artificial Sequence
  Centrosome-associated protein 350 (621-633)
gccaccgagcagaagaacaaaagacugcaagaacucuac

SEQ ID NO: 72598 - RNA, 33 nt, Artificial Sequence
  Uncharacterized aarF domain-containing protein kinase 2 (137-147)
gccaccgagacaagcggccccacuuacaucaag

SEQ ID NO: 72599 - RNA, 36 nt, Artificial Sequence
  Protein Tob1 (180-191)
gccaccuucgcugcaacaaaguuuggcagcacuaaa

SEQ ID NO: 72600 - RNA, 30 nt, Artificial Sequence
  FAST kinase domain-containing protein 2 (426-435)
gccaccuucgacaucuggaaguuuagaaaa

SEQ ID NO: 72601 - RNA, 33 nt, Artificial Sequence
  Nephrocystin-3 (43-53)
gccaccuucgagcacgacagagauaaggugaaa

SEQ ID NO: 72602 - RNA, 30 nt, Artificial Sequence
  Calcium-binding protein 39 (186-195)
gccaccuucaaggaccugcucacaagacac

SEQ ID NO: 72603 - RNA, 27 nt, Artificial Sequence
  cAMP-specific 3',5'-cyclic phosphodiesterase 4B (107-115)
gccaccuuccccggccacagccagaga

SEQ ID NO: 72604 - RNA, 27 nt, Artificial Sequence
  Kynurenine-oxoglutarate transaminase 3 (99-107)
gccaccuuccccggcaugugggagaga

SEQ ID NO: 72605 - RNA, 27 nt, Artificial Sequence
  Pleckstrin homology domain-containing family H member 1 (733-741)
gccaccggccccccugcucugcucaga

SEQ ID NO: 72606 - RNA, 33 nt, Artificial Sequence
  von Willebrand factor A domain-containing protein 5A (184-194)
gccaccaucgacagccagcacggcauugagaag

SEQ ID NO: 72607 - RNA, 33 nt, Artificial Sequence
  General transcription factor IIH subunit 2 (32-42)
gccaccaucgaggacauucuguucaaggcuaaa

SEQ ID NO: 72608 - RNA, 27 nt, Artificial Sequence
  F-BAR domain only protein 2 (41-49)
gccaccaucgaggaagcuuacagcaga

SEQ ID NO: 72609 - RNA, 39 nt, Artificial Sequence
  DNA-binding protein RFX7 (683-695)
gccaccaucgagggccagaagcaagggagcgugaaaaag

SEQ ID NO: 72610 - RNA, 27 nt, Artificial Sequence
  Mitochondrial Rho GTPase 2 (88-96)
gccaccaucgagaagauuagaacaaaa

SEQ ID NO: 72611 - RNA, 33 nt, Artificial Sequence
  Transformation/transcription domain-associated protein (1416-1426)
gccaccaucgagguggaccagauucacacacau

SEQ ID NO: 72612 - RNA, 36 nt, Artificial Sequence
  Vacuolar-sorting protein SNF8 (73-84)
gccaccaucggcguggacccccuggcuagcgggaag

SEQ ID NO: 72613 - RNA, 27 nt, Artificial Sequence
  Inhibitor of Bruton tyrosine kinase (45-53)
gccaccaucaaggacguguucggcaga

SEQ ID NO: 72614 - RNA, 33 nt, Artificial Sequence
  Probable ATP-dependent RNA helicase DDX60-like (899-909)
gccaccaucaacaaucccaaccugcucacaaag

SEQ ID NO: 72615 - RNA, 30 nt, Artificial Sequence
  Ankyrin repeat domain-containing protein 17 (1306-1315)
gccaccaucacagacaaggagaugcugaaa

SEQ ID NO: 72616 - RNA, 27 nt, Artificial Sequence
  Signal recognition particle 54 kDa protein (152-160)
gccaccaaggcuagaauccccuucuac

SEQ ID NO: 72617 - RNA, 27 nt, Artificial Sequence
  Fanconi anemia group I protein (138-146)
gccaccaagaaagagaaccuggcuuac

SEQ ID NO: 72618 - RNA, 30 nt, Artificial Sequence
  Gephyrin (610-619)
gccacccuggacaucgauggcgugagaaag

SEQ ID NO: 72619 - RNA, 27 nt, Artificial Sequence
  Histone deacetylase 10 (469-477)
gccacccuggacguggcugucagaagg

SEQ ID NO: 72620 - RNA, 30 nt, Artificial Sequence
  MOB kinase activator 1A (76-85)
gccacccugggcagcgggaaccucagacag

SEQ ID NO: 72621 - RNA, 27 nt, Artificial Sequence
  ADP-ribosylation factor-like protein 2 (118-126)
gccacccugcucaucuucgcuaacaag

SEQ ID NO: 72622 - RNA, 33 nt, Artificial Sequence
  Telomerase protein component 1 (53-63)
gccacccugcccgaccucaagacaauggagaaa

SEQ ID NO: 72623 - RNA, 27 nt, Artificial Sequence
  Septin-4 (109-117)
gccacccugcccaaccaggugcacaga

SEQ ID NO: 72624 - RNA, 30 nt, Artificial Sequence
  Glycogen phosphorylase, muscle form (303-312)
gccacccugcaggacaucauuagaagguuc

SEQ ID NO: 72625 - RNA, 33 nt, Artificial Sequence
  PH domain leucine-rich repeat-containing protein phosphatase 1 (228-238)
gccacccugagcgaggaaacaaacuccauccuc

SEQ ID NO: 72626 - RNA, 27 nt, Artificial Sequence
  Kazrin (140-148)
gccacccugacaaaggacgugcccaaa

SEQ ID NO: 72627 - RNA, 33 nt, Artificial Sequence
  BUB3-interacting and GLEBS motif-containing protein ZNF207 (352-362)
gccacccugacaacuacgagcgcuaccuccaag

SEQ ID NO: 72628 - RNA, 30 nt, Artificial Sequence
  Eukaryotic initiation factor 4A-III (5-14)
gccaccauggcuacaagcggcuccgcaaga

SEQ ID NO: 72629 - RNA, 39 nt, Artificial Sequence
  Eukaryotic translation initiation factor 3 subunit J (234-246)
gccaccaugaaggacgaucuggcugacuacggcggguau

SEQ ID NO: 72630 - RNA, 48 nt, Artificial Sequence
  Eukaryotic translation initiation factor 3 subunit J (234-249)
gccaccaugaaggacgaucuggcugacuacggcggguaugauggaggu

SEQ ID NO: 72631 - RNA, 30 nt, Artificial Sequence
  Growth hormone-inducible transmembrane protein (334-343)
gccaccaugcuggcuacaggcgggaacaga

SEQ ID NO: 72632 - RNA, 36 nt, Artificial Sequence
  Growth hormone-inducible transmembrane protein (334-345)
gccaccaugcuggcuacaggcgggaacagaaagaaa

SEQ ID NO: 72633 - RNA, 33 nt, Artificial Sequence
  Signal recognition particle subunit SRP68 (260-270)
gccaccaugagcgagguggaauggagaggcagg

SEQ ID NO: 72634 - RNA, 33 nt, Artificial Sequence
  Protein phosphatase 1G (149-159)
gccaccaugacaaucgaggaacugcucacuaga

SEQ ID NO: 72635 - RNA, 27 nt, Artificial Sequence
  E3 ubiquitin-protein ligase HECTD1 (175-183)
gccaccaacaauaugaaccugagcaga

SEQ ID NO: 72636 - RNA, 30 nt, Artificial Sequence
  X-ray repair cross-complementing protein 6 (454-463)
gccacccccgagcaggugggcaagaugaaa

SEQ ID NO: 72637 - RNA, 30 nt, Artificial Sequence
  Cytoplasmic dynein 1 heavy chain 1 (3980-3989)
gccacccccaucggccaggcuauucacaga

SEQ ID NO: 72638 - RNA, 27 nt, Artificial Sequence
  Estradiol 17-beta-dehydrogenase 11 (131-139)
gccacccaggacccccaaaucgagaag

SEQ ID NO: 72639 - RNA, 45 nt, Artificial Sequence
  Calsyntenin-1 (947-961)
gccaccagacagcaacagcuggagugggacgauagcacacucucc

SEQ ID NO: 72640 - RNA, 48 nt, Artificial Sequence
  Calsyntenin-1 (947-962)
gccaccagacagcaacagcuggagugggacgauagcacacucuccuac

SEQ ID NO: 72641 - RNA, 27 nt, Artificial Sequence
  Intron-binding protein aquarius (1477-1485)
gccaccagcgcucccgaggaaacaaag

SEQ ID NO: 72642 - RNA, 27 nt, Artificial Sequence
  Kelch repeat and BTB domain-containing protein 4 (535-543)
gccaccagcgcugugacagucacuaga

SEQ ID NO: 72643 - RNA, 33 nt, Artificial Sequence
  Basement membrane-specific heparan sulfate proteoglycan core protein (2027-2037)
gccaccagccccgcuggcacagcacaggccaga

SEQ ID NO: 72644 - RNA, 27 nt, Artificial Sequence
  Neural cell adhesion molecule L1 (1237-1245)
gccaccagccccaucaacccugcugug

SEQ ID NO: 72645 - RNA, 27 nt, Artificial Sequence
  G-protein coupled receptor 143 (61-69)
gccaccagccccccugcuuccgugaga

SEQ ID NO: 72646 - RNA, 30 nt, Artificial Sequence
  Melanoma-associated antigen D1 (132-141)
gccaccacaggcgagcuggcugcaaacaag

SEQ ID NO: 72647 - RNA, 33 nt, Artificial Sequence
  Sterol regulatory element-binding protein 1 (957-967)
gccaccacacccgcuagcuccucuaucgacaag

SEQ ID NO: 72648 - RNA, 27 nt, Artificial Sequence
  Helicase SKI2W (127-135)
gccaccacaagccugucccucagaagg

SEQ ID NO: 72649 - RNA, 27 nt, Artificial Sequence
  E3 ubiquitin-protein ligase RING1 (290-298)
gccaccguggaccaccugagcaaguac

SEQ ID NO: 72650 - RNA, 33 nt, Artificial Sequence
  ATP-dependent RNA helicase DHX29 (735-745)
gccaccguggacagcgagaaguucuccacauac

SEQ ID NO: 72651 - RNA, 27 nt, Artificial Sequence
  Multidrug resistance-associated protein 4 (364-372)
gccaccgugcuguucggcaucgcuaga

SEQ ID NO: 72652 - RNA, 27 nt, Artificial Sequence
  FACT complex subunit SPT16 (415-423)
gccaccgugcugacaagcgucaagaaa

SEQ ID NO: 72653 - RNA, 30 nt, Artificial Sequence
  Putative phospholipase B-like 2 (360-369)
gccaccugggcugacaucuucaagagauuu

SEQ ID NO: 72654 - RNA, 27 nt, Artificial Sequence
  Arf-GAP with GTPase, ANK repeat and PH domain-containing protein 3 (232-240)
gccaccuacggccugaacguggagaga

SEQ ID NO: 72655 - RNA, 27 nt, Artificial Sequence
  Histone acetyltransferase p300 (1189-1197)
gccaccuacuauagcuaccagaacaga

SEQ ID NO: 72656 - RNA, 27 nt, Artificial Sequence
  Girdin (155-163)
gccguggcugcacacauccaggagguc

SEQ ID NO: 72657 - RNA, 39 nt, Artificial Sequence
  Sodium/potassium-transporting ATPase subunit alpha-1 (249-261)
gccguggcuggcgacgcaagcgaguccgcccugcucaag

SEQ ID NO: 72658 - RNA, 36 nt, Artificial Sequence
  RanBP-type and C3HC4-type zinc finger-containing protein 1 (18-29)
gccguggcuggcggggacgagcaggucgcaaugaag

SEQ ID NO: 72659 - RNA, 33 nt, Artificial Sequence
  Mitochondrial import inner membrane translocase subunit Tim13 (31-41)
gccguggcuaacgcacaggagcugcuccaaaga

SEQ ID NO: 72660 - RNA, 33 nt, Artificial Sequence
  cDNA FLJ78342 (66-76)
gccguggcucagauggacuucaucaagcuguac

SEQ ID NO: 72661 - RNA, 30 nt, Artificial Sequence
  Serine/threonine-protein kinase ATR (1642-1651)
gccguggcuagcuucagauccaaggcauac

SEQ ID NO: 72662 - RNA, 27 nt, Artificial Sequence
  G-protein coupled receptor 143 (219-227)
gccguggcuagccugcucaagggcaga

SEQ ID NO: 72663 - RNA, 27 nt, Artificial Sequence
  Cadherin EGF LAG seven-pass G-type receptor 2 (2176-2184)
gccguggcuagcgucaucauuuacaga

SEQ ID NO: 72664 - RNA, 27 nt, Artificial Sequence
  Signal peptidase complex catalytic subunit SEC11A (119-127)
gccguggacgauagaggccuguacaag

SEQ ID NO: 72665 - RNA, 33 nt, Artificial Sequence
  MICOS complex subunit MIC60 (276-286)
gccguggacgaggcugcagaugcccugcucaag

SEQ ID NO: 72666 - RNA, 30 nt, Artificial Sequence
  Multivesicular body subunit 12A (118-127)
gccguguucgacgucagacugagcggcaag

SEQ ID NO: 72667 - RNA, 27 nt, Artificial Sequence
  Peroxisomal multifunctional enzyme type 2 (271-279)
gccguguucgaguggcacaucaccaag

SEQ ID NO: 72668 - RNA, 48 nt, Artificial Sequence
  Peroxisomal multifunctional enzyme type 2 (648-663)
gccguguucgaguggcacaucaccaagggcgggaacauuggagcuaaa

SEQ ID NO: 72669 - RNA, 30 nt, Artificial Sequence
  Transmembraneoprotein NMB (550-559)
gccguguucuuucccggcaaccaggagaag

SEQ ID NO: 72670 - RNA, 27 nt, Artificial Sequence
  Transmembrane protein 50A (132-140)
gccguguucuuucagaacgcuuucauc

SEQ ID NO: 72671 - RNA, 27 nt, Artificial Sequence
  tRNA-splicing endonuclease subunit Sen2 (4-12)
gccguguuccacgcucccaagagaaaa

SEQ ID NO: 72672 - RNA, 27 nt, Artificial Sequence
  Kinesin-like protein KIF13B (224-232)
gccguguucaagaucacccugacacac

SEQ ID NO: 72673 - RNA, 30 nt, Artificial Sequence
  Kinesin-like protein KIF1B (252-261)
gccguguucaccaucgucuuuacacagaag

SEQ ID NO: 72674 - RNA, 33 nt, Artificial Sequence
  GMP synthase (glutamine-hydrolyzing) (400-410)
gccgugcacaucgacaacggcuucaugagaaag

SEQ ID NO: 72675 - RNA, 27 nt, Artificial Sequence
  Lysosomal-trafficking regulator (2018-2026)
gccgugcaccccccuaccaacacauac

SEQ ID NO: 72676 - RNA, 27 nt, Artificial Sequence
  Disintegrin and metalloproteinase domain-containing protein 10 (184-192)
gccgugaucgcucagauuagcucccac

SEQ ID NO: 72677 - RNA, 36 nt, Artificial Sequence
  UDP-N-acetylglucosamine-peptide N-acetylglucosaminyltransferase 110 kDa subunit (593-604)
gccgugaucgacuucaagagcaacggccacauuuac

SEQ ID NO: 72678 - RNA, 30 nt, Artificial Sequence
  Armadillo repeat-containing X-linked protein 5 (128-137)
gccgugaucgaggcuaacauuagaagcuac

SEQ ID NO: 72679 - RNA, 30 nt, Artificial Sequence
  Cytoplasmic dynein 1 heavy chain 1 (3288-3297)
gccgugaucgaggcucagaacgcagucaag

SEQ ID NO: 72680 - RNA, 30 nt, Artificial Sequence
  Tyrosine-protein phosphatase non-receptor type 1 (109-118)
gccgugaucgagggcgcuaaguucauuaug

SEQ ID NO: 72681 - RNA, 27 nt, Artificial Sequence
  Adenosine 3'-phospho 5'-phosphosulfate transporter 2 (240-248)
gccgugaucggcaacguccaggagaag

SEQ ID NO: 72682 - RNA, 30 nt, Artificial Sequence
  Protocadherin Fat 4 (1541-1550)
gccgugaucggcagcguccugaccacaauu

SEQ ID NO: 72683 - RNA, 30 nt, Artificial Sequence
  Kinesin-like protein KIF1B (391-400)
gccgugaucaacgaggaccccaaugcuaag

SEQ ID NO: 72684 - RNA, 39 nt, Artificial Sequence
  RING finger protein 37 (351-363)
gccgugauccccagcuccauuguccugccuucucagaag

SEQ ID NO: 72685 - RNA, 27 nt, Artificial Sequence
  DNA repair protein SWI5 homolog isoform 2 (175-183)
gccgugaucagaggcgucaccacaaag

SEQ ID NO: 72686 - RNA, 30 nt, Artificial Sequence
  Zinc finger protein 28 homolog (116-125)
gccgugaucaccgagagacugacaagcuac

SEQ ID NO: 72687 - RNA, 30 nt, Artificial Sequence
  Eukaryotic translation initiation factor 3 subunit E (260-269)
gccgugaucaccaacaaggacgucagaaaa

SEQ ID NO: 72688 - RNA, 30 nt, Artificial Sequence
  Proline-rich protein 13 (52-61)
gccgugaucgucgacaagaaaaugcagaag

SEQ ID NO: 72689 - RNA, 27 nt, Artificial Sequence
  Heat shock 70 kDa protein 4 (349-357)
gccgugaaggagaaaaucagcaaguuc

SEQ ID NO: 72690 - RNA, 27 nt, Artificial Sequence
  Very long-chain specific acyl-CoA dehydrogenase, mitochondrial (252-260)
gccgugaaggagaaaaucaccgcuuuc

SEQ ID NO: 72691 - RNA, 27 nt, Artificial Sequence
  Heat shock protein 105 kDa (349-357)
gccgugaaggagagaaucgcuaaauuc

SEQ ID NO: 72692 - RNA, 27 nt, Artificial Sequence
  Hermansky-Pudlak syndrome 5 protein (25-33)
gccgugaaggagagcgucuccucuuuc

SEQ ID NO: 72693 - RNA, 33 nt, Artificial Sequence
  Interleukin-1 receptor accessory protein (505-515)
gccgugaaggagaccaaagucaaggaacugaaa

SEQ ID NO: 72694 - RNA, 30 nt, Artificial Sequence
  Actin-related protein 2/3 complex subunit 4 (75-84)
gccgugaagcaggcugacgagaucgaaaaa

SEQ ID NO: 72695 - RNA, 27 nt, Artificial Sequence
  Phosphatidylinositol 4,5-bisphosphate 3-kinase catalytic subunit beta isoform (406-414)
gccgugcuggacaaggucaaaaccaag

SEQ ID NO: 72696 - RNA, 27 nt, Artificial Sequence
  Periodic tryptophan protein 1 homolog (46-54)
gccgugcuggaccucagcuggaacaag

SEQ ID NO: 72697 - RNA, 27 nt, Artificial Sequence
  Glutamate receptor ionotropic, NMDA 2A (236-244)
gccgugcugauccucagcgaggcuaga

SEQ ID NO: 72698 - RNA, 27 nt, Artificial Sequence
  ADP-ribosylation factor 5 (119-127)
gccgugcugcucgucuucgcuaacaag

SEQ ID NO: 72699 - RNA, 33 nt, Artificial Sequence
  Casein kinase II subunit alpha' (340-350)
gccgugcugagcuccggccucaccgcugcaaga

SEQ ID NO: 72700 - RNA, 36 nt, Artificial Sequence
  COP9 signalosome complex subunit 8 (4-15)
gccgugauggcugagagcgcauucuccuuuaagaaa

SEQ ID NO: 72701 - RNA, 30 nt, Artificial Sequence
  FACT complex subunit SPT16 (328-337)
gccgugauggacgucguuaagaaacagaag

SEQ ID NO: 72702 - RNA, 27 nt, Artificial Sequence
  Prefoldin subunit 5 (143-151)
gccgugauggagaugaugagccagaag

SEQ ID NO: 72703 - RNA, 33 nt, Artificial Sequence
  DNA-directed RNA polymerase I subunit RPA1 (330-340)
gccgugaugaaggacgucguucugaucagaaaa

SEQ ID NO: 72704 - RNA, 27 nt, Artificial Sequence
  Pleckstrin homology domain-containing family A member 1 (203-211)
gccgugaugaagaacuggaaaagaagg

SEQ ID NO: 72705 - RNA, 27 nt, Artificial Sequence
  Catenin beta-1 (172-180)
gccgugaugguccaccagcugagcaag

SEQ ID NO: 72706 - RNA, 30 nt, Artificial Sequence
  Galectin-3 (212-221)
gccgugaacgacgcucaccugcuccaguac

SEQ ID NO: 72707 - RNA, 27 nt, Artificial Sequence
  CDC42 small effector protein 1 (56-64)
gccgugcaggagcaaaugagaagcaag

SEQ ID NO: 72708 - RNA, 30 nt, Artificial Sequence
  Transforming growth factor-beta-induced protein ig-h3 (50-59)
gccgugcagaaggucaucggcaccaacaga

SEQ ID NO: 72709 - RNA, 30 nt, Artificial Sequence
  26S proteasome non-ATPase regulatory subunit 6 (44-53)
gccgugagagacaacaauauggcucccuac

SEQ ID NO: 72710 - RNA, 27 nt, Artificial Sequence
  Amidophosphoribosyltransferase (196-204)
gccgugagagaccccuacggcaacagg

SEQ ID NO: 72711 - RNA, 30 nt, Artificial Sequence
  WD repeat-containing protein 63 (83-92)
gccgugagcgacuuccaccccgucaagaaa

SEQ ID NO: 72712 - RNA, 27 nt, Artificial Sequence
  GRAM domain-containing protein 4 (475-483)
gccgugagcacccccuccacacagaag

SEQ ID NO: 72713 - RNA, 27 nt, Artificial Sequence
  Hyaluronidase-2 (16-24)
gccgugagcugggcuauggagcugaag

SEQ ID NO: 72714 - RNA, 36 nt, Artificial Sequence
  72 kDa type IV collagenase (603-614)
gccguggucgaccugcagggcgggggacacagcuac

SEQ ID NO: 72715 - RNA, 27 nt, Artificial Sequence
  Folliculin-interacting protein 1 (548-556)
gccguggucgaccagaucaccagacac

SEQ ID NO: 72716 - RNA, 30 nt, Artificial Sequence; identical to SEQ ID NO: 48489
  Calcineurin subunit B type 1 (155-164)

SEQ ID NO: 72717 - RNA, 33 nt, Artificial Sequence
  Calcineurin subunit B type 1 (155-165)
gccguggucggcgggcuggacauccacaagaaa

SEQ ID NO: 72718 - RNA, 27 nt, Artificial Sequence
  Dolichyl-diphosphooligosaccharide-proteinosyltransferase subunit STT3A (152-160)
gccgugguccccggcuacaucagcaga

SEQ ID NO: 72719 - RNA, 33 nt, Artificial Sequence; identical to SEQ ID NO: 48492
  Nodal modulator 3 (366-376)

SEQ ID NO: 72720 - RNA, 30 nt, Artificial Sequence
  Protein phosphatase 1B (57-66)
gccguguacgacggccacgcugggagcaga

SEQ ID NO: 72721 - RNA, 33 nt, Artificial Sequence; identical to SEQ ID NO: 48494
  Biotinidase (61-71)

SEQ ID NO: 72722 - RNA, 30 nt, Artificial Sequence
  Protein-lysine N-methyltransferase METTL10 (40-49)
gccguguacgagagagaacugcagaccuuc

SEQ ID NO: 72723 - RNA, 33 nt, Artificial Sequence
  Carbonic anhydrase 14 (307-317)
gccguguacuucaucgcuagaaagauuaggaaa

SEQ ID NO: 72724 - RNA, 27 nt, Artificial Sequence
  TBC1 domain family member 16 (146-154)
gccguguacaaccccgcugucggcuau

SEQ ID NO: 72725 - RNA, 27 nt, Artificial Sequence
  Tetraspanin-4 (42-50)
gccuacaccgacaagaucgauagauau

SEQ ID NO: 72726 - RNA, 33 nt, Artificial Sequence
  Protein HIRA (749-759)
ugcguggccugugagaagagaaugcugagcguc

SEQ ID NO: 72727 - RNA, 33 nt, Artificial Sequence
  Heterogeneous nuclear ribonucleoprotein A0 (150-160)
gacgccgcugauaaggcagccguggucaaauuc

SEQ ID NO: 72728 - RNA, 33 nt, Artificial Sequence
  Gelsolin (291-301)
gacgccgcuaacagaaagcuggcaaaacucuac

SEQ ID NO: 72729 - RNA, 33 nt, Artificial Sequence
  Thimet oligopeptidase (401-411)
gacgccgcuagcggcgagguggucgggaaguuc

SEQ ID NO: 72730 - RNA, 27 nt, Artificial Sequence
  WD repeat-containing protein 61 (85-93)
gacgcccacaucagacugugggaucuc

SEQ ID NO: 72731 - RNA, 27 nt, Artificial Sequence
  Delta-1-pyrroline-5-carboxylate synthase (648-656)
gacgccaucgaucacauucauaaguac

SEQ ID NO: 72732 - RNA, 27 nt, Artificial Sequence
  Serine/arginine-rich splicing factor 9 (67-75)
gacgccaucuacggcagaaacggguau

SEQ ID NO: 72733 - RNA, 33 nt, Artificial Sequence
  DNA-directed RNA polymerases I, II, and III subunit RPABC5 (33-43)
gacgcccuggaugcucucggccuuaagagauac

SEQ ID NO: 72734 - RNA, 33 nt, Artificial Sequence
  Cell division cycle protein 16 homolog (140-150)
gacgcccuggauaacagaacccucgcuacauac

SEQ ID NO: 72735 - RNA, 27 nt, Artificial Sequence
  Mitogen-activated protein kinase kinase kinase 1 (693-701)
gacgccaacagcagaaccucccagcug

SEQ ID NO: 72736 - RNA, 27 nt, Artificial Sequence
  28S ribosomal protein S22, mitochondrial (296-304)
gacgccaccaaccuggugcagcucuac

SEQ ID NO: 72737 - RNA, 30 nt, Artificial Sequence
  Kinase D-interacting substrate of 220 kDa (264-273)
gacgccuacagagaguauaucgcucagaug

SEQ ID NO: 72738 - RNA, 33 nt, Artificial Sequence
  Actin, aortic smooth muscle (58-68)
gacgaggcccagagcaagagaggcauccugacc

SEQ ID NO: 72739 - RNA, 27 nt, Artificial Sequence
  Remodeling and spacing factor 1 (1413-1421)
gacgagcugcucagagugaccgaucuu

SEQ ID NO: 72740 - RNA, 27 nt, Artificial Sequence
  28S ribosomal protein S14, mitochondrial (49-57)
gacgagagacugaggaucaacagccuc

SEQ ID NO: 72741 - RNA, 27 nt, Artificial Sequence
  Kinesin-like protein KIF15 (1289-1297)
gacgagguggaaagaacccagacacug

SEQ ID NO: 72742 - RNA, 27 nt, Artificial Sequence
  CAP-Gly domain-containing linker protein 1 (519-527)
gaccaccagagagagaucaccagccug

SEQ ID NO: 72743 - RNA, 27 nt, Artificial Sequence
  Peroxisome proliferator-activated receptor gamma coactivator-related protein 1 (1261-1269)
gaccacuaccagagacaaagggugcug

SEQ ID NO: 72744 - RNA, 27 nt, Artificial Sequence
  Poly (ADP-ribose) polymerase 1 (993-1001)
gacaucgcccaggugaaccugaaguac

SEQ ID NO: 72745 - RNA, 30 nt, Artificial Sequence; identical to SEQ ID NO: 48518
  RILP-like protein 1 (29-38)

SEQ ID NO: 72746 - RNA, 30 nt, Artificial Sequence
  Probable ATP-dependent RNA helicase DDX58 (896-905)
gacaucgccaccggcgugcagacacuguac

SEQ ID NO: 72747 - RNA, 27 nt, Artificial Sequence
  RNA-binding protein 8A (72-80)
gacauccacgauaaguucgccgaguac

SEQ ID NO: 72748 - RNA, 30 nt, Artificial Sequence
  Filamin-A (897-906)
gacaucauugaucaccaugacaacaccuac

SEQ ID NO: 72749 - RNA, 36 nt, Artificial Sequence
  SURP and G-patch domain-containing protein 2 (265-276)
gacaucauugauaagagcgacguguucuccagauuu

SEQ ID NO: 72750 - RNA, 27 nt, Artificial Sequence
  Lymphocyte cytosolic protein 2 (500-508)
gacaucauugauuacuucagaaagaug

SEQ ID NO: 72751 - RNA, 30 nt, Artificial Sequence
  Cytoplasmic dynein 2 heavy chain 1 (253-262)
gacaucauuggcgggagcuucggaagauuu

SEQ ID NO: 72752 - RNA, 33 nt, Artificial Sequence
  Protein farnesyltransferase subunit beta (120-130)
gacaucauuaacagagagaagcugcuccaguac

SEQ ID NO: 72753 - RNA, 39 nt, Artificial Sequence
  Delta(24)-sterol reductase (252-264)
gacaucauucccuucggcaacaauccuauauuuagauac

SEQ ID NO: 72754 - RNA, 39 nt, Artificial Sequence
  Putative annexin A2-like protein (158-170)
gacaucauuagcgauaccuccggcgacuucagaaagcug

SEQ ID NO: 72755 - RNA, 27 nt, Artificial Sequence
  Nucleophosmin (246-254)
gacaucaaggccaaaaugcaggcuagc

SEQ ID NO: 72756 - RNA, 27 nt, Artificial Sequence
  Actin, alpha skeletal muscle (7-15)
gacaucaaggagaaacugugcuacgug

SEQ ID NO: 72757 - RNA, 27 nt, Artificial Sequence
  Ubiquitin fusion degradation protein 1 homolog (289-297)
gacaucaagagaggcauucccaacuac

SEQ ID NO: 72758 - RNA, 30 nt, Artificial Sequence
  POZ-, AT hook-, and zinc finger-containing protein 1 (116-125)
gacauccuggauuucgccuacaccagcaga

SEQ ID NO: 72759 - RNA, 27 nt, Artificial Sequence
  Pre-mRNA-processing-splicing factor 8 (298-306)
gacaucaacaagauuauaaucagacag

SEQ ID NO: 72760 - RNA, 27 nt, Artificial Sequence
  Trimethyllysine dioxygenase, mitochondrial (352-360)
gacauccccgagagaauucugaccuac

SEQ ID NO: 72761 - RNA, 30 nt, Artificial Sequence
  5'-nucleotidase domain-containing protein 1 (161-170)
gacaucguggccgcuauucagcacaacuac

SEQ ID NO: 72762 - RNA, 27 nt, Artificial Sequence
  Integrin-linked protein kinase (81-89)
gacaucgugcagaagcugcuccaauac

SEQ ID NO: 72763 - RNA, 30 nt, Artificial Sequence
  Calcium/calmodulin-dependent protein kinase type 1 (83-92)
gacaucuacgagagcggcgggcaccuguau

SEQ ID NO: 72764 - RNA, 30 nt, Artificial Sequence
  Pantothenate kinase 2, mitochondrial (45-54)
gacaucuacggcggggauuaugagagauuc

SEQ ID NO: 72765 - RNA, 30 nt, Artificial Sequence
  F-box only protein 11 (39-48)
gacaucuacaaccacauguauagcggcgug

SEQ ID NO: 72766 - RNA, 27 nt, Artificial Sequence
  Translin-associated protein X (51-59)
gacaaguacgagagacuggugaaacuc

SEQ ID NO: 72767 - RNA, 27 nt, Artificial Sequence
  R3H and coiled-coil domain-containing protein 1 (315-323)
gaccuggcccacguggucgagaucuac

SEQ ID NO: 72768 - RNA, 27 nt, Artificial Sequence
  CUGBP Elav-like family member 5 (41-49)
gaccuggaugccaucaagcucuucgug

SEQ ID NO: 72769 - RNA, 36 nt, Artificial Sequence
  Lanosterol 14-alpha demethylase (473-484)
gaccugaucgauggcuacuuccccaccgugaacuau

SEQ ID NO: 72770 - RNA, 27 nt, Artificial Sequence
  Heterogeneous nuclear ribonucleoprotein A0 (113-121)
gaccugaucgagcacuucagccaguuu

SEQ ID NO: 72771 - RNA, 27 nt, Artificial Sequence
  DNA polymerase zeta catalytic subunit (2457-2465)
gaccugaucggcaagaccagcgagaug

SEQ ID NO: 72772 - RNA, 33 nt, Artificial Sequence
  Probable fibrosin-1 (455-465)
gaccugaucggccaggaucucaacagcagauac

SEQ ID NO: 72773 - RNA, 36 nt, Artificial Sequence
  DNA repair endonuclease XPF (720-731)
gaccugaucggcagccucaacaaugggagacuuuac

SEQ ID NO: 72774 - RNA, 27 nt, Artificial Sequence
  Alpha-catulin (622-630)
gaccugauccaccagcucgagguguuc

SEQ ID NO: 72775 - RNA, 27 nt, Artificial Sequence
  Spermidine synthase (215-223)
gaccugaucaaggagaugagacaguuc

SEQ ID NO: 72776 - RNA, 27 nt, Artificial Sequence
  Reticulon-4 (494-502)
gaccugaucaaggagaccaaacucagc

SEQ ID NO: 72777 - RNA, 33 nt, Artificial Sequence
  Rho guanine nucleotide exchange factor 1 (77-87)
gaccugaucagcgaggaugugcagagaagguuc

SEQ ID NO: 72778 - RNA, 30 nt, Artificial Sequence
  Microtubule-associated serine/threonine-protein kinase 4 (1003-1012)
gaccugaucacccacauuaacggcgagccc

SEQ ID NO: 72779 - RNA, 27 nt, Artificial Sequence
  Calcium/calmodulin-dependent protein kinase kinase 2 (186-194)
gaccugaaggaucucaucaccagaaug

SEQ ID NO: 72780 - RNA, 27 nt, Artificial Sequence
  Heterogeneous nuclear ribonucleoprotein A/B (85-93)
gaccugaaggauuacuucaccaaauuu

SEQ ID NO: 72781 - RNA, 27 nt, Artificial Sequence
  Mediator of RNA polymerase II transcription subunit 8 (21-29)
gaccugaagaacagccucggcuccuuc

SEQ ID NO: 72782 - RNA, 27 nt, Artificial Sequence
  CASP8 and FADD-like apoptosis regulator (163-171)
gaccugaagaccaaaauccagaaguac

SEQ ID NO: 72783 - RNA, 33 nt, Artificial Sequence
  Glycogen (starch) synthase, muscle (593-603)
gaccugcucgauuggaaguaccuuggcagauau

SEQ ID NO: 72784 - RNA, 30 nt, Artificial Sequence
  Fez family zinc finger protein 1 isoform 2 (119-128)
gaccugcucaacugcgcccuuagccugaag

SEQ ID NO: 72785 - RNA, 27 nt, Artificial Sequence
  EPM2A-interacting protein 1 (205-213)
gaccugcucaccaucauuaaccuuaca

SEQ ID NO: 72786 - RNA, 30 nt, Artificial Sequence
  Sorting nexin-17 (151-160)
gaccugcccgaugaccucaucggcuacuuc

SEQ ID NO: 72787 - RNA, 27 nt, Artificial Sequence
  UBAP1-MVB12-associated (UMA)-domain containing protein 1 isoform b (71-79)
gaccugcccgaucaccuccuuagcuac

SEQ ID NO: 72788 - RNA, 30 nt, Artificial Sequence
  Rap guanine nucleotide exchange factor 2 (604-613)
gaccugcccgaucaggugcucagagucuuc

SEQ ID NO: 72789 - RNA, 33 nt, Artificial Sequence
  Class E basic helix-loop-helix protein 40 (21-31)
gaccugcccggcauguacccugcccacauguau

SEQ ID NO: 72790 - RNA, 27 nt, Artificial Sequence
  Coiled-coil domain-containing protein 22 (96-104)
gaccugagagaucuccuucuguucuug

SEQ ID NO: 72791 - RNA, 33 nt, Artificial Sequence
  Transient receptor potential cation channel subfamily M member 1 (109-119)
gaccuggugggcaaggaugucaccagaguuuac

SEQ ID NO: 72792 - RNA, 30 nt, Artificial Sequence
  Regulatory-associated protein of mTOR (292-301)
gaccuggugaaggauaacggccacaaauac

SEQ ID NO: 72793 - RNA, 30 nt, Artificial Sequence; identical to SEQ ID NO: 48566
  Holliday junction recognition protein (177-186)

SEQ ID NO: 72794 - RNA, 27 nt, Artificial Sequence
  Zinc finger protein 1 homolog (74-82)
gaccuguacgagaagacccucaaauau

SEQ ID NO: 72795 - RNA, 27 nt, Artificial Sequence
  Cytoplasmic FMR1-interacting protein 1 (703-711)
gaccuguacaacgauagcgcccacuau

SEQ ID NO: 72796 - RNA, 30 nt, Artificial Sequence
  DNA (cytosine-5)-methyltransferase 1 (862-871)
gaccuguaccccgagcacuauagaaaguac

SEQ ID NO: 72797 - RNA, 27 nt, Artificial Sequence
  Phosphoglycerate kinase 1 (52-60)
gacaacggcgccaagagcgugguccug

SEQ ID NO: 72798 - RNA, 27 nt, Artificial Sequence
  60S ribosomal protein L23 (30-38)
gacaacaccggcgccaagaaucuguac

SEQ ID NO: 72799 - RNA, 27 nt, Artificial Sequence
  Nuclear pore complex protein Nup88 (194-202)
gacaacgugaucagaauuuacagccug

SEQ ID NO: 72800 - RNA, 36 nt, Artificial Sequence
  KAT8 regulatory NSL complex subunit 2 (176-187)
gaccaggaggauccccugaagcacgccggcguguac

SEQ ID NO: 72801 - RNA, 36 nt, Artificial Sequence
  EH domain-containing protein 1 (222-233)
gaccagaucgagacccaacagcugaugagaguguac

SEQ ID NO: 72802 - RNA, 39 nt, Artificial Sequence
  Eukaryotic translation initiation factor 3 subunit C-like protein (888-900)
gaccagaaggauggcuacagaaaaaacgagggguauaug

SEQ ID NO: 72803 - RNA, 27 nt, Artificial Sequence
  Isoleucine-tRNA ligase, cytoplasmic (424-432)
gaccagcugcucagaaacaaugaucuu

SEQ ID NO: 72804 - RNA, 27 nt, Artificial Sequence
  V-type proton ATPase subunit H (445-453)
gaccagcaagugagauacaacgcccug

SEQ ID NO: 72805 - RNA, 27 nt, Artificial Sequence
  Neuroblastoma-amplified sequence (1664-1672)
gaccaguacaagagagagaccauccug

SEQ ID NO: 72806 - RNA, 30 nt, Artificial Sequence
  GTPase KRas (69-78)
gaccaguacaugagaaccggcgagggguuc

SEQ ID NO: 72807 - RNA, 27 nt, Artificial Sequence
  Vigilin (368-376)
gacagagcccugaggagcuucaagcuc

SEQ ID NO: 72808 - RNA, 27 nt, Artificial Sequence
  Tyrosine-protein kinase BAZ1B (189-197)
gacagagaggauaagaggagcgcccug

SEQ ID NO: 72809 - RNA, 27 nt, Artificial Sequence
  Clathrin heavy chain 1 (779-787)
gacagauucgauuuugugcacgaccug

SEQ ID NO: 72810 - RNA, 27 nt, Artificial Sequence
  KxDL motif-containing protein 1 (43-51)
gacagauucgagaagaccaacgaaaug

SEQ ID NO: 72811 - RNA, 27 nt, Artificial Sequence
  PAB-dependent poly(A)-specific ribonuclease subunit PAN2 (264-272)
gacagauuccugaagguguacgaucuc

SEQ ID NO: 72812 - RNA, 27 nt, Artificial Sequence
  Monofunctional C1-tetrahydrofolate synthase, mitochondrial (503-511)
gacagauuccugaggaagaucaccauu

SEQ ID NO: 72813 - RNA, 27 nt, Artificial Sequence
  Cyclin-G1 (81-89)
gacagauuccugagcaagaugaaagug

SEQ ID NO: 72814 - RNA, 27 nt, Artificial Sequence
  Lanosterol synthase (287-295)
gacagauucaccaagagcaucuccauu

SEQ ID NO: 72815 - RNA, 27 nt, Artificial Sequence
  Vacuolar protein sorting-associated protein 51 homolog (86-94)
gacagacacgagaggaucaccaagcug

SEQ ID NO: 72816 - RNA, 27 nt, Artificial Sequence
  Endoplasmin (716-724)
gacagaaucgagaggaugcugcggcuc

SEQ ID NO: 72817 - RNA, 27 nt, Artificial Sequence
  Transcription elongation factor SPT5 (314-322)
gacagaaucaaggccaggaugagccug

SEQ ID NO: 72818 - RNA, 27 nt, Artificial Sequence
  Regulator of nonsense transcripts 3B (254-262)
gacagaauccccgagagggauaagcug

SEQ ID NO: 72819 - RNA, 30 nt, Artificial Sequence
  Coatomer subunit epsilon (160-169)
gacagacuggaucucgccaggaaggagcuu

SEQ ID NO: 72820 - RNA, 27 nt, Artificial Sequence
  DNA-dependent protein kinase catalytic subunit (2537-2545)
gacagacugcucgcccuuaacagccug

SEQ ID NO: 72821 - RNA, 27 nt, Artificial Sequence
  DNA replication complex GINS protein PSF1 (82-90)
gacagacugcucaggauccgggcccuu

SEQ ID NO: 72822 - RNA, 27 nt, Artificial Sequence
  Telomerase-binding protein EST1A (484-492)
gacagaaaccugagggugaaggcccuc

SEQ ID NO: 72823 - RNA, 27 nt, Artificial Sequence
  SUMO-activating enzyme subunit 1 (20-28)
gacagacagaucaggcuguggggccuc

SEQ ID NO: 72824 - RNA, 27 nt, Artificial Sequence
  Phenylalanine-tRNA ligase alpha subunit (353-361)
gacagaguguucaggaacgagacccug

SEQ ID NO: 72825 - RNA, 27 nt, Artificial Sequence
  T-complex protein 1 subunit zeta (127-135)
gacagagugaagaaaaucauugagcug

SEQ ID NO: 72826 - RNA, 27 nt, Artificial Sequence
  39S ribosomal protein L20, mitochondrial (16-24)
gacagauacuucaggauccaggaggug

SEQ ID NO: 72827 - RNA, 27 nt, Artificial Sequence
  Spectrin alpha chain, non-erythrocytic 1 (24-32)
gacagauaccacagguucaaggagcug

SEQ ID NO: 72828 - RNA, 27 nt, Artificial Sequence
  Small nuclear ribonucleoprotein Sm D2 (93-101)
gacagauacaucagcaagauguuccug

SEQ ID NO: 72829 - RNA, 27 nt, Artificial Sequence
  Nuclear factor of activated T-cells, cytoplasmic 3 (487-495)
gacagauaccugaggccccacgccuuc

SEQ ID NO: 72830 - RNA, 27 nt, Artificial Sequence
  60S ribosomal protein L27 (47-55)
gacagauaccccaggaaggugaccgcc

SEQ ID NO: 72831 - RNA, 27 nt, Artificial Sequence
  Ubiquitin carboxyl-terminal hydrolase 45 (410-418)
gacagauacagcggcaacgugaccauc

SEQ ID NO: 72832 - RNA, 27 nt, Artificial Sequence
  Major prion protein (147-155)
gacagauacuauagggagaacaugcac

SEQ ID NO: 72833 - RNA, 30 nt, Artificial Sequence
  Nucleolar protein 4-like (309-318)
gacagcgccgcuaucacccacuccacauac

SEQ ID NO: 72834 - RNA, 30 nt, Artificial Sequence; identical to SEQ ID NO: 48607
  Splicing factor U2AF 65 kDa subunit (293-302)

SEQ ID NO: 72835 - RNA, 30 nt, Artificial Sequence
  Eukaryotic translation initiation factor 4 gamma 3 (1501-1510)
gacagcgauaccgagaaggaacugcaggcc

SEQ ID NO: 72836 - RNA, 30 nt, Artificial Sequence
  Gamma-glutamylaminecyclotransferase (138-147)
gacagcgagggcccccacgggcugagauac

SEQ ID NO: 72837 - RNA, 36 nt, Artificial Sequence
  Bromodomain and WD repeat-containing protein 1 (1792-1803)
gacagcgagcccggcagauccgggggaaggaaguac

SEQ ID NO: 72838 - RNA, 30 nt, Artificial Sequence
  RNA-binding protein 39 (262-271)
gacagcgagaccggcagauccaagggguac

SEQ ID NO: 72839 - RNA, 27 nt, Artificial Sequence
  Bcl-2-like protein 12 (183-191)
gacagcuucgccagacugguggagcuc

SEQ ID NO: 72840 - RNA, 27 nt, Artificial Sequence
  Melanophilin (443-451)
gacagcuucgauagaaaguccguguac

SEQ ID NO: 72841 - RNA, 27 nt, Artificial Sequence
  TBC1 domain family member 4 (590-598)
gacagcuucgagagauccaacucucug

SEQ ID NO: 72842 - RNA, 30 nt, Artificial Sequence
  Signal transducer and activator of transcription 1-alpha/beta (24-33)
gacagcuuccccauggagaucagacaguac

SEQ ID NO: 72843 - RNA, 33 nt, Artificial Sequence
  Signal transducer and activator of transcription 1-alpha/beta (24-34)
gacagcuuccccauggagaucagacaguaccug

SEQ ID NO: 72844 - RNA, 30 nt, Artificial Sequence
  Signal transducer and activator of transcription 3 (24-33)
gacagcuuccccauggagcugagacaguuu

SEQ ID NO: 72845 - RNA, 36 nt, Artificial Sequence
  Syndecan-3 (294-305)
gacagcggcuccucugccgcucagcugccccaaaag

SEQ ID NO: 72846 - RNA, 30 nt, Artificial Sequence
  Protein MON2 homolog (1214-1223)
gacagcaucggcgagaagcuggggagauac

SEQ ID NO: 72847 - RNA, 27 nt, Artificial Sequence
  Disco-interacting protein 2 homolog A (882-890)
gacagcauccaccaggugggcgucuac

SEQ ID NO: 72848 - RNA, 27 nt, Artificial Sequence
  ATP-dependent RNA helicase DDX54 (547-555)
gacagcaucaagaacuacagauccagg

SEQ ID NO: 72849 - RNA, 27 nt, Artificial Sequence
  Peptidyl-prolyl cis-trans isomerase FKBP9 (369-377)
gacagcaucuccauuaccucucacuac

SEQ ID NO: 72850 - RNA, 27 nt, Artificial Sequence
  Methyltransferase-like protein 13 (209-217)
gacagcaaggaucccacccugggcaug

SEQ ID NO: 72851 - RNA, 27 nt, Artificial Sequence
  Protein AHNAK2 (672-680)
gacagcaaguucaaaaugcccaaguuu

SEQ ID NO: 72852 - RNA, 30 nt, Artificial Sequence
  Arf-GAP with SH3 domain, ANK repeat and PH domain-containing protein 2 (284-293)
gacagccagaucagacaauccaccgccuac

SEQ ID NO: 72853 - RNA, 27 nt, Artificial Sequence
  RNA-binding protein 3 (119-127)
gacagcagacccggcggguacggauau

SEQ ID NO: 72854 - RNA, 27 nt, Artificial Sequence
  T-complex protein 1 subunit alpha (459-467)
gacagcaccgaucugguggccaagcuc

SEQ ID NO: 72855 - RNA, 27 nt, Artificial Sequence
  Signal-induced proliferation-associated 1-like protein 2 (438-446)
gacagcaccggcacacacucccuguac

SEQ ID NO: 72856 - RNA, 33 nt, Artificial Sequence
  Heterogeneous nuclear ribonucleoprotein A1-like 2 (4-14)
gacagcguggauaagaucgucauucagaaauac

SEQ ID NO: 72857 - RNA, 33 nt, Artificial Sequence
  Mitochondrial import inner membrane translocase subunit TIM50 (212-222)
gacagcguggauccccacggcuucaucuccuac

SEQ ID NO: 72858 - RNA, 27 nt, Artificial Sequence
  Basement membrane-specific heparan sulfate proteoglycan core protein (608-616)
gacagcuacggcgggucccugagauau

SEQ ID NO: 72859 - RNA, 27 nt, Artificial Sequence
  Transmembrane and TPR repeat-containing protein 1 (529-537)
gacaccgccgaggcuaagauguacuau

SEQ ID NO: 72860 - RNA, 27 nt, Artificial Sequence
  Methylthioribose-1-phosphate isomerase (208-216)
gacaccgccaacaaggugggcacauac

SEQ ID NO: 72861 - RNA, 30 nt, Artificial Sequence
  Apoptogenic protein 1, mitochondrial (36-45)
gacaccgcccccagcggcguguccagauuc

SEQ ID NO: 72862 - RNA, 39 nt, Artificial Sequence
  Solute carrier family 35 member B1 (75-87)
gacaccgccagaguggauaggacacggagcuggcuguac

SEQ ID NO: 72863 - RNA, 42 nt, Artificial Sequence
  Heterogeneous nuclear ribonucleoproteins A2/B1 (110-123)
gacaccgaggaacaccaucugagagauuacuucgaggaauau

SEQ ID NO: 72864 - RNA, 42 nt, Artificial Sequence
  Heat shock 70 kDa protein 1-like (48-61)
gacaccgagagacugaucggcgaugccgcuaagaaccaggug

SEQ ID NO: 72865 - RNA, 27 nt, Artificial Sequence
  N-acetylglucosamine-1-phosphotransferase subunits alpha/beta (929-937)
gacaccuucgccgauagccugagauac

SEQ ID NO: 72866 - RNA, 27 nt, Artificial Sequence
  AT-rich interactive domain-containing protein 5B (227-235)
gacaccuucgaucaccccacacugauc

SEQ ID NO: 72867 - RNA, 33 nt, Artificial Sequence
  Transcription factor SOX-6 (351-361)
gacaccuucgagcacggcgggggacauagcuac

SEQ ID NO: 72868 - RNA, 27 nt, Artificial Sequence
  Triple functional domain protein (2621-2629)
gacaccuucgagacacccacuagcuac

SEQ ID NO: 72869 - RNA, 33 nt, Artificial Sequence
  Dolichyl-diphosphooligosaccharide-proteinosyltransferase subunit 1 (402-412)
gacaccuucggcagacccgugaucgucgccuac

SEQ ID NO: 72870 - RNA, 33 nt, Artificial Sequence
  CTTNBP2 N-terminal-like protein (57-67)
gacaccuucaucgaggaaagauacggcaaguau

SEQ ID NO: 72871 - RNA, 30 nt, Artificial Sequence
  UTP-glucose-1-phosphate uridylyltransferase (237-246)
gacaccuucaucggcgaggggaaggaauac

SEQ ID NO: 72872 - RNA, 39 nt, Artificial Sequence; identical to SEQ ID NO: 48645
  Interferon-related developmental regulator 1 (375-387)

SEQ ID NO: 72873 - RNA, 30 nt, Artificial Sequence
  H2.0-like homeobox protein (254-263)
gacaccuuccccggcccuuacgccgugcug

SEQ ID NO: 72874 - RNA, 27 nt, Artificial Sequence
  G-protein coupled receptor 126 (533-541)
gacaccuucagccacuccacaaaguuu

SEQ ID NO: 72875 - RNA, 27 nt, Artificial Sequence
  Rhophilin-2 (261-269)
gacaccuucacacacacucccagcuac

SEQ ID NO: 72876 - RNA, 27 nt, Artificial Sequence
  40S ribosomal protein S14 (39-47)
gacaccuucgugcacgucacagaucug

SEQ ID NO: 72877 - RNA, 30 nt, Artificial Sequence
  Lysosomal glucocerebrosidase precursor (428-437)
gacaccuucuacaagcagcccauguuuuau

SEQ ID NO: 72878 - RNA, 27 nt, Artificial Sequence
  Zinc finger CCCH-type with G patch domain-containing protein (515-523)
gacacccacaagaaaaugacagaguuc

SEQ ID NO: 72879 - RNA, 27 nt, Artificial Sequence
  Utrophin (3189-3197)
gacacccacagcagaaucgagcaguac

SEQ ID NO: 72880 - RNA, 30 nt, Artificial Sequence
  C2 domain-containing protein 5 (611-620)
gacaccaucgccaagaacaaagagcuguac

SEQ ID NO: 72881 - RNA, 36 nt, Artificial Sequence
  Polyadenylate-binding protein 4 (303-314)
gacaccaucgaugacgagaagcugagaaaagaauuc

SEQ ID NO: 72882 - RNA, 33 nt, Artificial Sequence
  Plastin-3 (116-126)
gacaccaucgaugagagagccauuaacaagaaa

SEQ ID NO: 72883 - RNA, 27 nt, Artificial Sequence
  Kin of IRRE-like protein 1 (277-285)
gacaccaucgauacaagagaggaauac

SEQ ID NO: 72884 - RNA, 42 nt, Artificial Sequence
  Small ubiquitin-related modifier 2 isoform b precursor (58-71)
gacaccaucgauguguuccagcaacagacaggcggggucuac

SEQ ID NO: 72885 - RNA, 36 nt, Artificial Sequence
  SUMO-activating enzyme subunit 2 (50-61)
gacaccaucgaugugagcaaccugaauagacaguuc

SEQ ID NO: 72886 - RNA, 27 nt, Artificial Sequence
  Tryptophan-tRNA ligase, cytoplasmic (382-390)
gacaccaucgaggaacacagacaguuc

SEQ ID NO: 72887 - RNA, 39 nt, Artificial Sequence
  Heterogeneous nuclear ribonucleoproteins A2/B1 (127-139)
gacaccaucgagauuauaacagauagacagagcggcaag

SEQ ID NO: 72888 - RNA, 27 nt, Artificial Sequence
  Unconventional myosin-Id (61-69)
gacaccaucgagcaguacaagggcaga

SEQ ID NO: 72889 - RNA, 36 nt, Artificial Sequence
  Ubiquitin-like protein 5 (22-33)
gacaccaucggcgaucugaagaaacucauugccgcu

SEQ ID NO: 72890 - RNA, 30 nt, Artificial Sequence
  Trifunctional purine biosynthetic protein adenosine-3 (45-54)
gacaccaucggccaggaucugguggccaug

SEQ ID NO: 72891 - RNA, 27 nt, Artificial Sequence
  Cytoplasmic polyadenylation element-binding protein 4 (17-25)
gacaccaucaagggcagacugaacuac

SEQ ID NO: 72892 - RNA, 27 nt, Artificial Sequence
  Mitochondrial dynamics protein MID51 (222-230)
gacaccaucaugaacgugcccggcuuc

SEQ ID NO: 72893 - RNA, 33 nt, Artificial Sequence; identical to SEQ ID NO: 48666
  UPF0489 protein C5orf22 (148-158)

SEQ ID NO: 72894 - RNA, 30 nt, Artificial Sequence
  Coiled-coil and C2 domain-containing protein 2A (426-435)
gacaccauccagaagacaauuaacgaguac

SEQ ID NO: 72895 - RNA, 27 nt, Artificial Sequence
  Interferon-induced helicase C domain-containing protein 1 (615-623)
gacaccaucagaaugauugaugccuac

SEQ ID NO: 72896 - RNA, 27 nt, Artificial Sequence
  Zinc finger protein 143 (92-100)
gacaccaucagcgcccuggagcaguac

SEQ ID NO: 72897 - RNA, 30 nt, Artificial Sequence
  Gamma-interferon-inducible protein 16 (447-456)
gacaccaucagcaagaugaacgauuucaug

SEQ ID NO: 72898 - RNA, 36 nt, Artificial Sequence
  Gamma-interferon-inducible protein 16 (447-458)
gacaccaucagcaagaugaacgauuucaugagaaug

SEQ ID NO: 72899 - RNA, 27 nt, Artificial Sequence
  Sphingolipid delta(4)-desaturase DES1 (268-276)
gacaccaucagccccuacuccagaaug

SEQ ID NO: 72900 - RNA, 33 nt, Artificial Sequence
  Pre-mRNA-splicing factor RBM22 (241-251)
gacaccaucacagagacugaucugagaaaccac

SEQ ID NO: 72901 - RNA, 36 nt, Artificial Sequence
  Pre-mRNA-splicing factor RBM22 (241-252)
gacaccaucacagagacugaucugagaaaccacuuc

SEQ ID NO: 72902 - RNA, 39 nt, Artificial Sequence
  Pre-mRNA-splicing factor RBM22 (241-253)
gacaccaucacagagacugaucugagaaaccacuucuac

SEQ ID NO: 72903 - RNA, 33 nt, Artificial Sequence
  Intermediate filament family orphan 1 (232-242)
gacaccaucacacccgagauuagagcccuguac

SEQ ID NO: 72904 - RNA, 30 nt, Artificial Sequence
  Condensin complex subunit 1 (61-70)
gacaccaucuacagcauucugcaccauuuc

SEQ ID NO: 72905 - RNA, 27 nt, Artificial Sequence
  Protein SCO1 homolog, mitochondrial (97-105)
gacaccaaggaggccaucgcuaacuac

SEQ ID NO: 72906 - RNA, 27 nt, Artificial Sequence
  Amyloid beta A4 protein (64-72)
gacaccaaggagggcauccugcaguac

SEQ ID NO: 72907 - RNA, 27 nt, Artificial Sequence
  Intraflagellar transport protein 74 homolog (328-336)
gacaccaaggagaaaaucaaccaguuc

SEQ ID NO: 72908 - RNA, 27 nt, Artificial Sequence
  Charged multivesicular body protein 5 (21-29)
gacaccaagacaacuguggaugccaug

SEQ ID NO: 72909 - RNA, 27 nt, Artificial Sequence
  DNA-directed RNA polymerase II subunit RPB2 (738-746)
gacacccuggcccacgugcucuacuau

SEQ ID NO: 72910 - RNA, 27 nt, Artificial Sequence
  Presenilin-2 (439-447)
gacacccuggccagccaccagcucuac

SEQ ID NO: 72911 - RNA, 27 nt, Artificial Sequence
  Acidic fibroblast growth factor intracellular-binding protein (55-63)
gacaccauggaucacuacagaacauuc

SEQ ID NO: 72912 - RNA, 27 nt, Artificial Sequence
  Parafibromin (134-142)
gacaccaugggcacauaccacgggaug

SEQ ID NO: 72913 - RNA, 30 nt, Artificial Sequence
  Dual specificity protein phosphatase 10 (341-350)
gacaccaugcagagacugaacaucggcuac

SEQ ID NO: 72914 - RNA, 27 nt, Artificial Sequence
  FRAS1-related extracellular matrix protein 2 (1562-1570)
gacacccccgauaagcugcucaaauuc

SEQ ID NO: 72915 - RNA, 27 nt, Artificial Sequence
  Translin-associated protein X (212-220)
gacacccccuucgaggugagccaguuu

SEQ ID NO: 72916 - RNA, 30 nt, Artificial Sequence
  Translation factor GUF1, mitochondrial (140-149)
gacacccccggccacguggauuucagcuac

SEQ ID NO: 72917 - RNA, 27 nt, Artificial Sequence
  Protein KIAA0100 (293-301)
gacacccccccuuucgcccugggcuuu

SEQ ID NO: 72918 - RNA, 27 nt, Artificial Sequence
  Nuclear receptor subfamily 4 group A member 2 (395-403)
gacacccagcacauccaacaguucuac

SEQ ID NO: 72919 - RNA, 27 nt, Artificial Sequence
  Nuclear protein localization protein 4 homolog (319-327)
gacaccagaaagggcacagugagguac

SEQ ID NO: 72920 - RNA, 27 nt, Artificial Sequence
  Nuclear pore complex protein Nup205 (1075-1083)
gacaccagcggccccacaaugagauac

SEQ ID NO: 72921 - RNA, 27 nt, Artificial Sequence
  Disintegrin and metalloproteinase domain-containing protein 10 (98-106)
gacaccagccacaucuacacaggccau

SEQ ID NO: 72922 - RNA, 30 nt, Artificial Sequence
  Protein YIF1B (38-47)
gacaccagcuccgcccagucuagaggcuac

SEQ ID NO: 72923 - RNA, 27 nt, Artificial Sequence
  NHS-like protein 1 (768-776)
gacaccagcuccgugaagucugaguac

SEQ ID NO: 72924 - RNA, 27 nt, Artificial Sequence
  Peptidyl-glycine alpha-amidating monooxygenase (99-107)
gacaccgugcaccauaugcugcucuuc

SEQ ID NO: 72925 - RNA, 27 nt, Artificial Sequence
  E3 SUMO-protein ligase RanBP2 (3197-3205)
gacaccgugaagaaaaucgagagcuuc

SEQ ID NO: 72926 - RNA, 27 nt, Artificial Sequence
  Nodal modulator 3 (6-14)
gacaccgugaagcagaugaacaaauac

SEQ ID NO: 72927 - RNA, 27 nt, Artificial Sequence
  Rho GTPase-activating protein 31 (892-900)
gacaccgugacagauaucgcccagcac

SEQ ID NO: 72928 - RNA, 33 nt, Artificial Sequence
  E3 ubiquitin-protein ligase MYLIP (278-288)
gacaccgugacaagcgccgucaugaugcaguac

SEQ ID NO: 72929 - RNA, 33 nt, Artificial Sequence
  Eukaryotic translation initiation factor 4H (5-15)
gacaccuacgaugacagagccuauagcuccuuc

SEQ ID NO: 72930 - RNA, 33 nt, Artificial Sequence
  Vacuolar fusion protein CCZ1 homolog (308-318)
gacaccuacgaggaacugcaccucaucguguau

SEQ ID NO: 72931 - RNA, 36 nt, Artificial Sequence
  Ethanolamine-phosphate cytidylyltransferase (124-135)
gacaccuacgaggaagugaagcaggccggcagauau

SEQ ID NO: 72932 - RNA, 36 nt, Artificial Sequence
  Beta-secretase 2 (127-138)
gacaccuacuucgauacagagagaagcuccacuuau

SEQ ID NO: 72933 - RNA, 30 nt, Artificial Sequence
  Glycoprotein endo-alpha-1,2-mannosidase-like protein (245-254)
gacaccuacggcagccacggggccuucuau

SEQ ID NO: 72934 - RNA, 30 nt, Artificial Sequence; identical to SEQ ID NO: 48707
  Mid1-interacting protein 1 (5-14)

SEQ ID NO: 72935 - RNA, 30 nt, Artificial Sequence
  Tetratricopeptide repeat protein 37 (1017-1026)
gacaccuacaacguggccaucagaaauuau

SEQ ID NO: 72936 - RNA, 30 nt, Artificial Sequence
  Zinc finger CCCH domain-containing protein 13 (520-529)
gacaccuaccccgaggaaagcagauccuau

SEQ ID NO: 72937 - RNA, 33 nt, Artificial Sequence
  Cartilage acidic protein 1 (17-27)
gacguggccgcugaggcaggcgucagcaaguac

SEQ ID NO: 72938 - RNA, 33 nt, Artificial Sequence
  Putative GTP-binding protein 6 (258-268)
gacguggcccacagcgaucugauccuccauguc

SEQ ID NO: 72939 - RNA, 27 nt, Artificial Sequence
  Polynucleotide 5'-hydroxyl-kinase NOL9 (563-571)
gacguggcccccacccacauccuguac

SEQ ID NO: 72940 - RNA, 36 nt, Artificial Sequence
  Hsc70-interacting protein (337-348)
gacguggcccagaaccccgcuaauaugagcaaguac

SEQ ID NO: 72941 - RNA, 33 nt, Artificial Sequence
  WD repeat domain-containing protein 83 (95-105)
gacguggccagcggccaggucguuagaaaguuc

SEQ ID NO: 72942 - RNA, 27 nt, Artificial Sequence
  Protein S100-B (13-21)
gacguguuccaccaguacagcggcaga

SEQ ID NO: 72943 - RNA, 30 nt, Artificial Sequence
  Sentrin-specific protease 5 (531-540)
gacguguucaacgaggauuuuagcaauaga

SEQ ID NO: 72944 - RNA, 30 nt, Artificial Sequence
  Nicotinamide phosphoribosyltransferase (94-103)
gacguguucaacgagaagggcuggaauuac

SEQ ID NO: 72945 - RNA, 30 nt, Artificial Sequence
  DNA excision repair protein ERCC-8 (78-87)
gacguguucaacuuugaggaaaccgucuac

SEQ ID NO: 72946 - RNA, 33 nt, Artificial Sequence
  Phosphomannomutase 1 (190-200)
gacguguuccccgagggcugggauaagagauac

SEQ ID NO: 72947 - RNA, 30 nt, Artificial Sequence
  Serine/threonine-protein kinase N3 (654-663)
gacguguuccccgagccucaggccagauuu

SEQ ID NO: 72948 - RNA, 30 nt, Artificial Sequence
  Solute carrier family 23 member 2 (334-343)
gacguguuccccccugauagcaccaaguac

SEQ ID NO: 72949 - RNA, 39 nt, Artificial Sequence
  Solute carrier family 23 member 2 (334-346)
gacguguuccccccugauagcaccaaguacggcuuuuau

SEQ ID NO: 72950 - RNA, 33 nt, Artificial Sequence
  MOB kinase activator 2 (126-136)
gacguguuccccaccaaguacggcagagaguuu

SEQ ID NO: 72951 - RNA, 30 nt, Artificial Sequence
  U4/U6.U5 tri-snRNP-associated protein 2 (186-195)
gacguguuccagggcagcaugagaaucuuu

SEQ ID NO: 72952 - RNA, 27 nt, Artificial Sequence
  Ankyrin repeat and BTB/POZ domain-containing protein 1 (59-67)
gacguguucacccacguccuguacuau

SEQ ID NO: 72953 - RNA, 39 nt, Artificial Sequence
  General transcription factor II-I (53-65)
gacguguucgucguuggcaccgagagagggagggccuuu

SEQ ID NO: 72954 - RNA, 36 nt, Artificial Sequence
  HLA class I histocompatibility antigen, A-1 alpha chain (101-112)
gacgugggccccgaugggagauuccugaggggauac

SEQ ID NO: 72955 - RNA, 30 nt, Artificial Sequence
  Histone deacetylase 6 (104-113)
gacgugcaccauggccaggggacccaauuc

SEQ ID NO: 72956 - RNA, 30 nt, Artificial Sequence
  Kaptin (205-214)
gacgugcacaacuuccccggcaccagcaga

SEQ ID NO: 72957 - RNA, 30 nt, Artificial Sequence
  Neutral alpha-glucosidase AB (329-338)
gacgugcacaacaucuacggccuguauguc

SEQ ID NO: 72958 - RNA, 27 nt, Artificial Sequence
  Speriolin-like protein (115-123)
gacgugcaccccgccuucagcgaguuu

SEQ ID NO: 72959 - RNA, 36 nt, Artificial Sequence
  Caveolin-1 (5-16)
gacgugaucgccgagcccgaaggcacccacagcuuc

SEQ ID NO: 72960 - RNA, 33 nt, Artificial Sequence
  Death effector domain-containing protein (51-61)
gacgugaucgaugaccacgagagaggccugauu

SEQ ID NO: 72961 - RNA, 27 nt, Artificial Sequence
  Protein LDOC1L (24-32)
gacgugaucgauacccugacaagccuc

SEQ ID NO: 72962 - RNA, 27 nt, Artificial Sequence
  Uncharacterized protein C20orf194 (832-840)
gacgugaucgaugucguucaggcccug

SEQ ID NO: 72963 - RNA, 27 nt, Artificial Sequence
  ATP-dependent RNA helicase DHX36 (400-408)
gacgugaucgagaagauuagauacguc

SEQ ID NO: 72964 - RNA, 33 nt, Artificial Sequence
  E3 ubiquitin-protein ligase RNF213 (1304-1314)
gacgugaucuucaaggauuuugucaacaaauac

SEQ ID NO: 72965 - RNA, 27 nt, Artificial Sequence
  60S ribosomal protein L3 (213-221)
gacgugaucggcgucaccaaggggaaa

SEQ ID NO: 72966 - RNA, 33 nt, Artificial Sequence
  60S ribosomal protein L3 (213-223)
gacgugaucggcgucaccaaggggaaaggauac

SEQ ID NO: 72967 - RNA, 36 nt, Artificial Sequence
  Triple functional domain protein (785-796)
gacgugauccaccagggccaagaucugcuccaguac

SEQ ID NO: 72968 - RNA, 27 nt, Artificial Sequence
  Ran GTPase-activating protein 1 (40-48)
gacgugaucaaggagauugaagauuuc

SEQ ID NO: 72969 - RNA, 27 nt, Artificial Sequence
  Spindle and kinetochore-associated protein 1 (163-171)
gacgugaucaaggagauuaacaaagcc

SEQ ID NO: 72970 - RNA, 30 nt, Artificial Sequence
  Cytoplasmic dynein 2 heavy chain 1 (2609-2618)
gacgugaucaagaaaggccugauucacuac

SEQ ID NO: 72971 - RNA, 27 nt, Artificial Sequence
  Fanconi anemia group D2 protein (348-356)
gacgugaucaagagcgccauuagauac

SEQ ID NO: 72972 - RNA, 27 nt, Artificial Sequence
  Elongation factor G, mitochondrial (730-738)
gacgugaucaacaaguaccuggaggcc

SEQ ID NO: 72973 - RNA, 39 nt, Artificial Sequence
  Thioredoxin-related transmembrane protein 4 (92-104)
gacgugauccaggagcccggccugagcgggagauucuuu

SEQ ID NO: 72974 - RNA, 27 nt, Artificial Sequence
  WD repeat-containing protein 26 (126-134)
gacgugaucagacugauuggccagcac

SEQ ID NO: 72975 - RNA, 27 nt, Artificial Sequence
  Coenzyme Q-binding protein COQ10 homolog B, mitochondrial (62-70)
gacgugaucagcaagagauccggcuac

SEQ ID NO: 72976 - RNA, 27 nt, Artificial Sequence
  Mediator of RNA polymerase II transcription subunit 27 (126-134)
gacgugaucagcagaauugauaggaug

SEQ ID NO: 72977 - RNA, 30 nt, Artificial Sequence
  Antigen KI-67 (86-95)
gacgugaucaccauuauagauagaagcuuc

SEQ ID NO: 72978 - RNA, 36 nt, Artificial Sequence
  Antigen KI-67 (86-97)
gacgugaucaccauuauagauagaagcuucagguac

SEQ ID NO: 72979 - RNA, 36 nt, Artificial Sequence
  ER membrane protein complex subunit 1 (96-107)
gacgugaucaccgucagcaacggcgggagaauuaug

SEQ ID NO: 72980 - RNA, 30 nt, Artificial Sequence
  40S ribosomal protein S18 (89-98)
gacgugaaggauggcaaauacagccagguc

SEQ ID NO: 72981 - RNA, 27 nt, Artificial Sequence
  Cell cycle progression protein 1 (703-711)
gacgugaaggauuaccugagaaacaug

SEQ ID NO: 72982 - RNA, 27 nt, Artificial Sequence
  Transmembrane protein 168 (117-125)
gacgugaaggaggaaagcaccaaauac

SEQ ID NO: 72983 - RNA, 27 nt, Artificial Sequence
  Nuclear pore complex protein Nup107 (812-820)
gacgugaaggagaaaauguacaacguc

SEQ ID NO: 72984 - RNA, 30 nt, Artificial Sequence
  UTP-glucose-1-phosphate uridylyltransferase (289-298)
gacgugaagggcgggacccugacacaguac

SEQ ID NO: 72985 - RNA, 27 nt, Artificial Sequence
  Lon protease homolog, mitochondrial (277-285)
gacgugaagaaaagaauccuggaguuc

SEQ ID NO: 72986 - RNA, 27 nt, Artificial Sequence
  DDB1- and CUL4-associated factor 4 (130-138)
gacgugaaggucggcgggagcaaauac

SEQ ID NO: 72987 - RNA, 39 nt, Artificial Sequence
  Lon protease homolog, mitochondrial (129-141)
gacgugcuggaggaaaccaacauccccaagagacucuac

SEQ ID NO: 72988 - RNA, 27 nt, Artificial Sequence
  AP-2 complex subunit mu (176-184)
gacgugcuggagagcgucaaccuccuu

SEQ ID NO: 72989 - RNA, 51 nt, Artificial Sequence
  PRKR-interacting protein 1 (66-82)
gacgugaugggcagcuccgccggggcuggaucuggugaguuccacgucuac

SEQ ID NO: 72990 - RNA, 27 nt, Artificial Sequence
  Rho-associated protein kinase 2 (99-107)
gacgugcccgagaagugggccaaauuc

SEQ ID NO: 72991 - RNA, 27 nt, Artificial Sequence
  Rho-associated protein kinase 1 (169-177)
gacgugcccgagaagugggccagauuc

SEQ ID NO: 72992 - RNA, 27 nt, Artificial Sequence
  Protein diaphanous homolog 2 (54-62)
gacgugagagauaggaucaccagcuuc

SEQ ID NO: 72993 - RNA, 27 nt, Artificial Sequence
  RIB43A-like with coiled-coils protein 2 (62-70)
gacgugagaaacaccaucagcggcaug

SEQ ID NO: 72994 - RNA, 27 nt, Artificial Sequence
  Dipeptidyl peptidase 1 (107-115)
gacgugaccgauuucaucagccaccug

SEQ ID NO: 72995 - RNA, 27 nt, Artificial Sequence
  RANBP2-like and GRIP domain-containing protein 2 (107-115)
gacgugaccgauggcagagccaaguac

SEQ ID NO: 72996 - RNA, 27 nt, Artificial Sequence
  TATA box-binding protein-associated factor RNA polymerase I subunit C (102-110)
gacgugaccgagcagaucagcagauuc

SEQ ID NO: 72997 - RNA, 30 nt, Artificial Sequence
  Zinc finger protein 552 (41-50)
gacgugacccuggagaaccucgcccuuaug

SEQ ID NO: 72998 - RNA, 27 nt, Artificial Sequence
  Bromodomain adjacent to zinc finger domain protein 1A (531-539)
gacgugaccagcgccaacgcuaaguac

SEQ ID NO: 72999 - RNA, 30 nt, Artificial Sequence
  Trafficking protein particle complex subunit 2-like protein (7-16)
gacguggucgaugagaagaucagcgccaug

SEQ ID NO: 73000 - RNA, 27 nt, Artificial Sequence
  Sorting nexin-8 (312-320)
gacguggucgagaagcugaaccucuuc

SEQ ID NO: 73001 - RNA, 33 nt, Artificial Sequence
  DCN1-like protein 4 (58-68)
gacguggucggccccgaggggauggaaaaguuc

SEQ ID NO: 73002 - RNA, 27 nt, Artificial Sequence
  Inositol-trisphosphate 3-kinase B (718-726)
gacguggucaaggauggcgagagauac

SEQ ID NO: 73003 - RNA, 27 nt, Artificial Sequence
  Cold shock domain-containing protein E1 (173-181)
gacguggucaaggagaucuucuuucac

SEQ ID NO: 73004 - RNA, 30 nt, Artificial Sequence
  Cold shock domain-containing protein E1 (173-182)
gacguggucaaggagaucuucuuucacuac

SEQ ID NO: 73005 - RNA, 39 nt, Artificial Sequence
  Peptidyl-prolyl cis-trans isomerase H (34-46)
gacgugguccccaagaccgccgagaacuucagacaguuu

SEQ ID NO: 73006 - RNA, 27 nt, Artificial Sequence
  Glypican-1 (232-240)
gacguggucagaaagguugcccaggug

SEQ ID NO: 73007 - RNA, 30 nt, Artificial Sequence
  F-box only protein 31 (25-34)
gacguguacgccaagcugcuccacagauau

SEQ ID NO: 73008 - RNA, 33 nt, Artificial Sequence
  26S proteasome non-ATPase regulatory subunit 1 (492-502)
gacguguacgaucugcucaagaccaaccuuuau

SEQ ID NO: 73009 - RNA, 33 nt, Artificial Sequence
  RNA polymerase II-associated factor 1 homolog (252-262)
gacguguacgauuauaagaucgccagagaguac

SEQ ID NO: 73010 - RNA, 33 nt, Artificial Sequence
  Cat eye syndrome critical region protein 5 (318-328)
gacguguacggcgccaaccuguuccaccaguau

SEQ ID NO: 73011 - RNA, 27 nt, Artificial Sequence
  Cystathionine gamma-lyase (112-120)
gacguguacggcgggaccaacagauau

SEQ ID NO: 73012 - RNA, 30 nt, Artificial Sequence
  Cystathionine gamma-lyase (112-121)
gacguguacggcgggaccaacagauauuuc

SEQ ID NO: 73013 - RNA, 30 nt, Artificial Sequence
  Transcription elongation factor SPT6 (339-348)
gacguguacaaccacuuccugcucuauuac

SEQ ID NO: 73014 - RNA, 30 nt, Artificial Sequence
  Inactive tyrosine-protein kinase 7 (954-963)
gacguguacaacagcgaguauuaccacuuc

SEQ ID NO: 73015 - RNA, 30 nt, Artificial Sequence
  Melanoma-associated antigen D1 (507-516)
gacguguaccccgagaucauugaaagagcc

SEQ ID NO: 73016 - RNA, 36 nt, Artificial Sequence
  Melanoma-associated antigen D2 (315-326)
gacguguaccccgagaucauugaaagagccggcuau

SEQ ID NO: 73017 - RNA, 33 nt, Artificial Sequence
  ATP synthase mitochondrial F1 complex assembly factor 1 (232-242)
gaggccgcugcaagccagcugauccucuaccac

SEQ ID NO: 73018 - RNA, 33 nt, Artificial Sequence
  Uncharacterized protein C20orf194 (141-151)
gaggccgcugaagaguucaagaucaccagcuuu

SEQ ID NO: 73019 - RNA, 36 nt, Artificial Sequence
  Calpain small subunit 1 (199-210)
gaggccgcuggcuuccaccugaacgaacaucucuac

SEQ ID NO: 73020 - RNA, 27 nt, Artificial Sequence
  Protein GREB1 (686-694)
gaggccgcucccgacaucaugcacuac

SEQ ID NO: 73021 - RNA, 33 nt, Artificial Sequence
  ATP-dependent DNA helicase Q4 (32-42)
gaggccgcucccgaagagaccagagcacuguac

SEQ ID NO: 73022 - RNA, 33 nt, Artificial Sequence
  Metal transporter CNNM3 (26-36)
gaggccgcucccggcccuagagugcugggguuc

SEQ ID NO: 73023 - RNA, 33 nt, Artificial Sequence
  Nucleoside diphosphate kinase, mitochondrial (131-141)
gaggccgcucccggcaccaucagaggggacuuc

SEQ ID NO: 73024 - RNA, 27 nt, Artificial Sequence
  3-hydroxy-3-methylglutaryl-coenzyme A reductase (567-575)
gaggccuucgacagcaccuccagauuu

SEQ ID NO: 73025 - RNA, 30 nt, Artificial Sequence
  Isovaleryl-CoA dehydrogenase, mitochondrial (310-319)
gaggccuucggccagaagaucgggcacuuu

SEQ ID NO: 73026 - RNA, 33 nt, Artificial Sequence
  Proteasome activator complex subunit 3 (94-104)
gaggccuuccagggcaccaagguguuugucaug

SEQ ID NO: 73027 - RNA, 30 nt, Artificial Sequence
  Proteasome activator complex subunit 2 (158-167)
gaggccuuccagaccacaaucagcaaguac

SEQ ID NO: 73028 - RNA, 27 nt, Artificial Sequence
  Chloride intracellular channel protein 1 (201-209)
gaggccuucagaggcgugcacagguac

SEQ ID NO: 73029 - RNA, 30 nt, Artificial Sequence
  Growth arrest-specific protein 8 (145-154)
gaggccuucaccgacaucaagaacuacuau

SEQ ID NO: 73030 - RNA, 27 nt, Artificial Sequence
  Ras-related protein Rab-27A (147-155)
gaggccaucgcucuggcagaaaaguac

SEQ ID NO: 73031 - RNA, 30 nt, Artificial Sequence
  Alpha-actinin-4 (524-533)
gaggccaucgaccagcugcaccucgaauac

SEQ ID NO: 73032 - RNA, 30 nt, Artificial Sequence
  Small integral membrane protein 8 (79-88)
gaggccaucgacagcgaaggccacuccuac

SEQ ID NO: 73033 - RNA, 33 nt, Artificial Sequence
  Small integral membrane protein 8 (79-89)
gaggccaucgacagcgaaggccacuccuacaug

SEQ ID NO: 73034 - RNA, 33 nt, Artificial Sequence
  Condensin complex subunit 1 (636-646)
gaggccaucggcauuauaagcaagaugauguac

SEQ ID NO: 73035 - RNA, 33 nt, Artificial Sequence
  Nuclear pore complex protein Nup133 (332-342)
gaggccaucaaggaaggcgugaacauuagauac

SEQ ID NO: 73036 - RNA, 30 nt, Artificial Sequence; identical to SEQ ID NO: 48809
  Synergin gamma (170-179)

SEQ ID NO: 73037 - RNA, 27 nt, Artificial Sequence
  N-lysine methyltransferase SMYD2 (289-297)
gaggccaucagagacauggugagguac

SEQ ID NO: 73038 - RNA, 33 nt, Artificial Sequence
  Trabeculin-alpha (3748-3758)
gaggccaucagccugcucaacuccgaaagauac

SEQ ID NO: 73039 - RNA, 30 nt, Artificial Sequence
  KN motif and ankyrin repeat domain-containing protein 1 (1144-1153)
gaggccaucagccccgacgugcugagauac

SEQ ID NO: 73040 - RNA, 39 nt, Artificial Sequence
  E3 ubiquitin-protein ligase Praja-1 (266-278)
gaggccaucagcuacguggacccccaguuccugaccuau

SEQ ID NO: 73041 - RNA, 27 nt, Artificial Sequence
  DNA replication licensing factor MCM5 (614-622)
gaggccaucgugagaauugcugaagca

SEQ ID NO: 73042 - RNA, 30 nt, Artificial Sequence
  Nucleoporin Nup43 (370-379)
gaggccaucuacgugaccagacaccuguuc

SEQ ID NO: 73043 - RNA, 33 nt, Artificial Sequence
  UDP-glucose 6-dehydrogenase (76-86)
gaggcccugaaccuccccgaaguggcuagauac

SEQ ID NO: 73044 - RNA, 27 nt, Artificial Sequence
  Centromere protein F (1214-1222)
gaggccaugcugagaaacaaggaacuc

SEQ ID NO: 73045 - RNA, 27 nt, Artificial Sequence
  Heme-binding protein 1 (57-65)
gaggccaugcccaagguggcuaaauac

SEQ ID NO: 73046 - RNA, 30 nt, Artificial Sequence; identical to SEQ ID NO: 48819
  Cytoskeleton-associated protein 5 (1575-1584)

SEQ ID NO: 73047 - RNA, 27 nt, Artificial Sequence
  Pre-mRNA-processing-splicing factor 8 (1105-1113)
gaggccagagaccugauccagagguac

SEQ ID NO: 73048 - RNA, 39 nt, Artificial Sequence
  Syntenin-1 (34-46)
gaggccagcgcucccaucccucacgacggcaaccuguac

SEQ ID NO: 73049 - RNA, 27 nt, Artificial Sequence
  Lysine-specific demethylase 7A (449-457)
gaggccaccagccccuaccacuccaga

SEQ ID NO: 73050 - RNA, 33 nt, Artificial Sequence; identical to SEQ ID NO: 48823
  TNF receptor-associated factor 5 (400-410)

SEQ ID NO: 73051 - RNA, 36 nt, Artificial Sequence
  Mitochondrial-processing peptidase subunit alpha (283-294)
gaggccguggacaucgauagaagcgucgcucaguac

SEQ ID NO: 73052 - RNA, 27 nt, Artificial Sequence
  Transcriptional enhancer factor TEF-3 (263-271)
gaggccguggacaucagacagauuuac

SEQ ID NO: 73053 - RNA, 30 nt, Artificial Sequence
  LIX1-like protein (28-37)
gaggccguggaagcugucguuagaagcuuc

SEQ ID NO: 73054 - RNA, 30 nt, Artificial Sequence; identical to SEQ ID NO: 48827
  Integrin alpha-7 (432-441)

SEQ ID NO: 73055 - RNA, 30 nt, Artificial Sequence
  Phosphatidylinositol 3-kinase regulatory subunit alpha (173-182)
gaggccgugggcaagaaacugcacgaauac

SEQ ID NO: 73056 - RNA, 30 nt, Artificial Sequence
  26S protease regulatory subunit 7 (411-420)
gaggccgugaacaaggucaucaaaagcuac

SEQ ID NO: 73057 - RNA, 27 nt, Artificial Sequence
  Methyltransferase-like protein 13 (244-252)
gaggccgugcaggaaagacaacaguac

SEQ ID NO: 73058 - RNA, 27 nt, Artificial Sequence
  Renalase (186-194)
gaggccgugagcuacuccucuagauau

SEQ ID NO: 73059 - RNA, 30 nt, Artificial Sequence
  Poly (ADP-ribose) polymerase 4 (695-704)
gaggccgugacccagggccacggggcuuac

SEQ ID NO: 73060 - RNA, 27 nt, Artificial Sequence
  Importin subunit alpha-1 (396-404)
gaggccgugugggcugucaccaacuac

SEQ ID NO: 73061 - RNA, 30 nt, Artificial Sequence
  DNA replication licensing factor MCM4 (656-665)
gaggccuacgacagaaggcuggcucaccau

SEQ ID NO: 73062 - RNA, 27 nt, Artificial Sequence
  Trafficking protein particle complex subunit 12 (300-308)
gaggccuaccacagcgugaucaaguau

SEQ ID NO: 73063 - RNA, 30 nt, Artificial Sequence
  Leucine-rich PPR motif-containing protein, mitochondrial (1198-1207)
gaggccuacaacagccugaugaaguccuau

SEQ ID NO: 73064 - RNA, 27 nt, Artificial Sequence
  Protein mago nashi homolog 2 (5-13)
gaggccuacgugcacaagagcgucaug

SEQ ID NO: 73065 - RNA, 27 nt, Artificial Sequence
  Coatomer subunit beta (79-87)
gaggccuacgugcacgucaaccaguau

SEQ ID NO: 73066 - RNA, 33 nt, Artificial Sequence
  Sorting and assembly machinery component 50 homolog (365-375)
gaggccuacugggcuggcgggcugcaccucuau

SEQ ID NO: 73067 - RNA, 27 nt, Artificial Sequence
  Superkiller viralicidic activity 2-like 2 (938-946)
gagugcgccaagagaaucgcuaaagug

SEQ ID NO: 73068 - RNA, 30 nt, Artificial Sequence
  Vimentin (180-189)
gaggacaucaugagacugagggaaaagcuc

SEQ ID NO: 73069 - RNA, 27 nt, Artificial Sequence
  U3 small nucleolar ribonucleoprotein protein IMP3 (43-51)
gaggacuacaccagauauaaccagcug

SEQ ID NO: 73070 - RNA, 27 nt, Artificial Sequence
  Ataxin-10 (298-306)
gaggaagcccuggcuaccaucagacuc

SEQ ID NO: 73071 - RNA, 30 nt, Artificial Sequence
  Transmembrane protein 150C (126-135)
gaggaaauccacaacgugggcaccagccug

SEQ ID NO: 73072 - RNA, 27 nt, Artificial Sequence
  Zinc finger FYVE domain-containing protein 16 (415-423)
gaggaaauccagaacagcgugguccug

SEQ ID NO: 73073 - RNA, 27 nt, Artificial Sequence
  Cofilin-1 (141-149)
gaggaagugaaggacagaugcacccug

SEQ ID NO: 73074 - RNA, 42 nt, Artificial Sequence; identical to SEQ ID NO: 48847
  Phosphoglycerate kinase 1 (404-417)

SEQ ID NO: 73075 - RNA, 27 nt, Artificial Sequence
  NADH dehydrogenase (ubiquinone) 1 alpha subcomplex subunit 11 (51-59)
gagggcguggccaaggucgggcaguac

SEQ ID NO: 73076 - RNA, 27 nt, Artificial Sequence
  (Pyruvate dehydrogenase (acetyl-transferring)) kinase isozyme 4, mitochondrial (229-237)
gagcaccaggaaaaccaacccagccug

SEQ ID NO: 73077 - RNA, 30 nt, Artificial Sequence
  Intraflagellar transport protein 172 homolog (6-15)
gagaucgccgaccaggugagcagagaauac

SEQ ID NO: 73078 - RNA, 27 nt, Artificial Sequence
  Alpha- and gamma-adaptin-binding protein p34 (72-80)
gagaucgccgaaagcgugcaggcuuuc

SEQ ID NO: 73079 - RNA, 27 nt, Artificial Sequence
  Cleavage and polyadenylation specificity factor subunit 3 (29-37)
gagaucgccggcgugaagcugcucuac

SEQ ID NO: 73080 - RNA, 30 nt, Artificial Sequence
  Carbohydrate sulfotransferase 10 (216-225)
gagaucgcccccggcauuauaagaaaguac

SEQ ID NO: 73081 - RNA, 30 nt, Artificial Sequence
  Fatty acid synthase (760-769)
gagaucgccccccacgcucugcuccaggca

SEQ ID NO: 73082 - RNA, 30 nt, Artificial Sequence
  Cullin-7 (1259-1268)
gagaucgccaccacauucgaacacuacuau

SEQ ID NO: 73083 - RNA, 30 nt, Artificial Sequence
  Exportin-2 (752-761)
gagaucuucgacggcauucagcccaagaug

SEQ ID NO: 73084 - RNA, 33 nt, Artificial Sequence
  Exportin-2 (752-762)
gagaucuucgacggcauucagcccaagauguuu

SEQ ID NO: 73085 - RNA, 27 nt, Artificial Sequence
  Utrophin (1655-1663)
gagaucuucgacggcaacguggcccac

SEQ ID NO: 73086 - RNA, 27 nt, Artificial Sequence
  Cold shock domain-containing protein E1 (177-185)
gagaucuucuuucacuacagcgaauuc

SEQ ID NO: 73087 - RNA, 33 nt, Artificial Sequence
  Neuron navigator 2 (2237-2247)
gagaucuucaacggccugcucaauugcaaguac

SEQ ID NO: 73088 - RNA, 30 nt, Artificial Sequence
  F-box only protein 25 (53-62)
gagaucuucaacaaugaagagcacgaauac

SEQ ID NO: 73089 - RNA, 30 nt, Artificial Sequence
  Ubiquitin-protein ligase E3A (558-567)
gagaucuucaaccccgacauuggcauguuu

SEQ ID NO: 73090 - RNA, 30 nt, Artificial Sequence
  Exportin-4 (988-997)
gagaucuuccccgaaaagauuccucagcug

SEQ ID NO: 73091 - RNA, 27 nt, Artificial Sequence
  Interferon-induced GTP-binding protein Mx1 (576-584)
gagaucuuccagcaccugauggccuac

SEQ ID NO: 73092 - RNA, 27 nt, Artificial Sequence
  Zinc finger CCCH-type antiviral protein 1 (57-65)
gagauccaccaucugcaccccgaauac

SEQ ID NO: 73093 - RNA, 39 nt, Artificial Sequence
  Nuclear pore complex protein Nup205 (794-806)
gagaucauugccuacaagcccccuggcuucagccugaug

SEQ ID NO: 73094 - RNA, 30 nt, Artificial Sequence
  Caseinolytic peptidase B protein homolog (651-660)
gagaucauugacaaggauagcaaaaccaga

SEQ ID NO: 73095 - RNA, 30 nt, Artificial Sequence
  Mitogen-activated protein kinase kinase kinase 6 (286-295)
gagaucauugaccagggccccagaggguac

SEQ ID NO: 73096 - RNA, 27 nt, Artificial Sequence
  Leucine-rich repeat and coiled-coil domain-containing protein 1 (237-245)
gagaucauugacagaaugcccgugaua

SEQ ID NO: 73097 - RNA, 30 nt, Artificial Sequence
  Brefeldin A-inhibited guanine nucleotide-exchange protein 2 (645-654)
gagaucauugaacacggcauagagcuguuc

SEQ ID NO: 73098 - RNA, 27 nt, Artificial Sequence
  Nuclear envelope integral membrane protein 1 (143-151)
gagaucauugaaaaggacaccaaauac

SEQ ID NO: 73099 - RNA, 27 nt, Artificial Sequence
  Complex I assembly factor TMEM126B, mitochondrial (25-33)
gagaucauugaaaagaacuucgacuac

SEQ ID NO: 73100 - RNA, 27 nt, Artificial Sequence
  MAGUK p55 subfamily member 5 (623-631)
gagaucauugaaaagaccagagagaug

SEQ ID NO: 73101 - RNA, 30 nt, Artificial Sequence
  Nucleolar pre-ribosomal-associated protein 1 (606-615)
gagaucauuggcggggaaagaagcguguuc

SEQ ID NO: 73102 - RNA, 33 nt, Artificial Sequence
  Ribosome-releasing factor 2, mitochondrial (541-551)
gagaucauucacgacagaauaaagagggaauac

SEQ ID NO: 73103 - RNA, 36 nt, Artificial Sequence
  ATP-dependent RNA helicase DDX3X (189-200)
gagaucauuaugggcaacauagaacugaccagauac

SEQ ID NO: 73104 - RNA, 30 nt, Artificial Sequence
  Bifunctional 3'-phosphoadenosine 5'-phosphosulfate synthase 2 (546-555)
gagaucauucccuucagaguggccgcuuac

SEQ ID NO: 73105 - RNA, 30 nt, Artificial Sequence
  Zinc finger protein 322 (34-43)
gagaucauucagauagacggccacaucuac

SEQ ID NO: 73106 - RNA, 33 nt, Artificial Sequence
  Tuftelin-interacting protein 11 (334-344)
gagaucauucagaacgacagacaacugcaguac

SEQ ID NO: 73107 - RNA, 27 nt, Artificial Sequence
  Polyadenylate-binding protein-interacting protein 1 (232-240)
gagaucauucagagaauagaaaacgug

SEQ ID NO: 73108 - RNA, 27 nt, Artificial Sequence
  AF4/FMR2 family member 3 (304-312)
gagaucauuagagaaaugaccuggcug

SEQ ID NO: 73109 - RNA, 36 nt, Artificial Sequence
  Centrosomal protein of 95 kDa (16-27)
gagaucauuagacugggcgacaccgcccacacauuc

SEQ ID NO: 73110 - RNA, 33 nt, Artificial Sequence
  Plectin (3616-3626)
gagaucauuagacagcaaggccuggccagcuac

SEQ ID NO: 73111 - RNA, 30 nt, Artificial Sequence
  Shugoshin-like 2 (621-630)
gagaucauuagcggcaugaaccacauguac

SEQ ID NO: 73112 - RNA, 27 nt, Artificial Sequence
  Serine/threonine-protein phosphatase 2A 55 kDa regulatory subunit B alpha isoform (283-291)
gagaucauuagcuccauaucugacgug

SEQ ID NO: 73113 - RNA, 30 nt, Artificial Sequence
  Mitochondrial-processing peptidase subunit alpha (407-416)
gagaucauuaccaaggaauucauacugaug

SEQ ID NO: 73114 - RNA, 30 nt, Artificial Sequence
  NEDD4-binding protein 1 (737-746)
gagaucauuaccaagagacugcuccaguac

SEQ ID NO: 73115 - RNA, 27 nt, Artificial Sequence
  Arf-GAP with Rho-GAP domain, ANK repeat and PH domain-containing protein 2 (579-587)
gagaucauuacccccuacagaagcuuc

SEQ ID NO: 73116 - RNA, 27 nt, Artificial Sequence
  40S ribosomal protein S16 (106-114)
gagaucaaggacauucugauacaguac

SEQ ID NO: 73117 - RNA, 27 nt, Artificial Sequence
  Peroxisomal NADH pyrophosphatase NUDT12 (204-212)
gagaucaaggacaaacugcucaacuac

SEQ ID NO: 73118 - RNA, 27 nt, Artificial Sequence
  Double-stranded RNA-specific adenosine deaminase (298-306)
gagaucaaggaaaaaauuugcgacuac

SEQ ID NO: 73119 - RNA, 27 nt, Artificial Sequence
  Ras association domain-containing protein 3 (53-61)
gagaucaaggaaaaagugcacaaguac

SEQ ID NO: 73120 - RNA, 27 nt, Artificial Sequence
  Hsc70-interacting protein (246-254)
gagaucaaggaaagaauugagagggug

SEQ ID NO: 73121 - RNA, 27 nt, Artificial Sequence
  Mixed lineage kinase domain-like protein (171-179)
gagaucaaggaaacccugagacaguac

SEQ ID NO: 73122 - RNA, 30 nt, Artificial Sequence
  Radixin (207-216)
gagaucaagaacaaaaagggcaccgaacug

SEQ ID NO: 73123 - RNA, 30 nt, Artificial Sequence
  40S ribosomal protein S15 (106-115)
gagaucaagcccgaaaugauuggccacuac

SEQ ID NO: 73124 - RNA, 27 nt, Artificial Sequence
  G1/S-specific cyclin-D3 (51-59)
gagaucaagccccacaugagaaaaaug

SEQ ID NO: 73125 - RNA, 27 nt, Artificial Sequence
  Coiled-coil domain-containing protein 93 (285-293)
gagaucaagcagauugugagcgaauac

SEQ ID NO: 73126 - RNA, 27 nt, Artificial Sequence
  Ras association domain-containing protein 5 (16-24)
gagaucaagcagaaaauugacagcuac

SEQ ID NO: 73127 - RNA, 30 nt, Artificial Sequence
  Heterogeneous nuclear ribonucleoprotein Q (352-361)
gagauccuggaaaaggccuucagccaguuu

SEQ ID NO: 73128 - RNA, 30 nt, Artificial Sequence
  Heterogeneous nuclear ribonucleoprotein R (257-266)
gagauccuggaaaagagcuucuccgaguuu

SEQ ID NO: 73129 - RNA, 36 nt, Artificial Sequence
  MRG/MORF4L-binding protein (94-105)
gagauccugcccuucccuaacccagaaagaaauuuu

SEQ ID NO: 73130 - RNA, 30 nt, Artificial Sequence
  Vacuolar protein sorting-associated protein 13A (700-709)
gagaucauggacagagccuacgauagcuuc

SEQ ID NO: 73131 - RNA, 30 nt, Artificial Sequence
  Structural maintenance of chromosomes protein 6 (921-930)
gagaucauggaacacagauucaagaccuac

SEQ ID NO: 73132 - RNA, 33 nt, Artificial Sequence
  Tyrosine-protein phosphatase non-receptor type 3 (704-714)
gagauccccgccgcuaaccuggugaauaaguac

SEQ ID NO: 73133 - RNA, 36 nt, Artificial Sequence
  Transmembrane emp24 domain-containing protein 4 (45-56)
gagauccccgacgaaaccauggugauuggcaacuac

SEQ ID NO: 73134 - RNA, 30 nt, Artificial Sequence
  Prostacyclin synthase (472-481)
gagauccccgaauucgaccugagcagauac

SEQ ID NO: 73135 - RNA, 27 nt, Artificial Sequence
  5,6-dihydroxyindole-2-carboxylic acid oxidase (465-473)
gagauccaguggcccagcagagaauuc

SEQ ID NO: 73136 - RNA, 33 nt, Artificial Sequence
  Fibronectin type III domain-containing protein 3B (823-833)
gagaucagagaccugcuccccgccgcucaguac

SEQ ID NO: 73137 - RNA, 27 nt, Artificial Sequence
  Elongation factor Tu, mitochondrial (198-206)
gagaucagagaacugcucaccgaguuc

SEQ ID NO: 73138 - RNA, 30 nt, Artificial Sequence
  Protein FAM46D (230-239)
gagaucagaggcgggggacugcucaaguac

SEQ ID NO: 73139 - RNA, 30 nt, Artificial Sequence
  Transcriptional repressor NF-X1 (64-73)
gagaucagcgccgugcaccagcauuccuac

SEQ ID NO: 73140 - RNA, 27 nt, Artificial Sequence
  DNA replication licensing factor MCM3 (496-504)
gagaucagcgaccacgugcugagaaug

SEQ ID NO: 73141 - RNA, 27 nt, Artificial Sequence
  Phospholipase D2 (660-668)
gagaucguggacagaauucugaaggcc

SEQ ID NO: 73142 - RNA, 27 nt, Artificial Sequence
  DNA-directed RNA polymerase III subunit RPC3 (19-27)
gagaucguggaaaagauuggcguccac

SEQ ID NO: 73143 - RNA, 30 nt, Artificial Sequence
  BRCA1-associated protein (136-145)
gagaucgugcacggcauuaugcaucuguac

SEQ ID NO: 73144 - RNA, 27 nt, Artificial Sequence
  DNA mismatch repair protein Msh2 (580-588)
gagaucgugaacauuagcuccggcuac

SEQ ID NO: 73145 - RNA, 27 nt, Artificial Sequence
  DNA-directed RNA polymerase III subunit RPC3 (265-273)
gagaucgugagaaccaugcugaggaug

SEQ ID NO: 73146 - RNA, 30 nt, Artificial Sequence
  Nuclear pore complex protein Nup160 (917-926)
gagaucgugagcacccccagacugcaguac

SEQ ID NO: 73147 - RNA, 30 nt, Artificial Sequence
  Alpha-soluble NSF attachment protein (43-52)
gagaucuacgccagagcugcaaacauguuc

SEQ ID NO: 73148 - RNA, 30 nt, Artificial Sequence
  Isocitrate dehydrogenase (NADP) cytoplasmic (130-139)
gagaucuacgacaagcaguauaaaagccaa

SEQ ID NO: 73149 - RNA, 30 nt, Artificial Sequence
  Oligodendrocyte transcription factor 2 (209-218)
gagaucuacggcgggcaccaugccggauuc

SEQ ID NO: 73150 - RNA, 39 nt, Artificial Sequence
  Splicing factor 3B subunit 1 (42-54)
gagaucuacggcgggagcgacuccagauucgccggauau

SEQ ID NO: 73151 - RNA, 27 nt, Artificial Sequence
  Plexin-C1 (1523-1531)
gagaucuacaaguauauugugaaauac

SEQ ID NO: 73152 - RNA, 30 nt, Artificial Sequence; identical to SEQ ID NO: 48925
  Kinesin-like protein KIF2C (403-412)

SEQ ID NO: 73153 - RNA, 30 nt, Artificial Sequence
  Cyclin E variant ex7del (18-27)
gagaucuaccccccuaagcugcaccaguuc

SEQ ID NO: 73154 - RNA, 27 nt, Artificial Sequence
  Coatomer subunit beta' (352-360)
gagaucuacccccagaccauucaacac

SEQ ID NO: 73155 - RNA, 27 nt, Artificial Sequence
  Replication factor C subunit 2 (159-167)
gagaucuacagcaagaccacaagauuc

SEQ ID NO: 73156 - RNA, 27 nt, Artificial Sequence
  Alpha-soluble NSF attachment protein (109-117)
gagaucuacaccgacaugggcagauuc

SEQ ID NO: 73157 - RNA, 27 nt, Artificial Sequence
  FYVE and coiled-coil domain-containing protein 1 (1096-1104)
gagaaggccaccacaaaaauccaggaa

SEQ ID NO: 73158 - RNA, 27 nt, Artificial Sequence
  Tripartite motif-containing protein 42 (167-175)
gagaagugccugagacagcuccaaaaa

SEQ ID NO: 73159 - RNA, 30 nt, Artificial Sequence
  Protein Mis18-beta (196-205)
gagaagaucgccgaacugaaagagaagauu

SEQ ID NO: 73160 - RNA, 30 nt, Artificial Sequence
  E3 ubiquitin-protein ligase TRIM13 (190-199)
gagaagcugcagcacacccucgaccaaaaa

SEQ ID NO: 73161 - RNA, 27 nt, Artificial Sequence
  AP-2 complex subunit alpha-1 (36-44)
gagcuggccaacaucagaagcaaguuc

SEQ ID NO: 73162 - RNA, 33 nt, Artificial Sequence
  L-dopachrome tautomerase (109-119)
gagcuggcccccaucggccacaacagaauguac

SEQ ID NO: 73163 - RNA, 27 nt, Artificial Sequence
  Prelamin-A/C (122-130)
gagcuggacuuccagaagaacaucuac

SEQ ID NO: 73164 - RNA, 33 nt, Artificial Sequence
  Unconventional myosin-Va (1068-1078)
gagcuggaccucaacgaugaaagacuuagguac

SEQ ID NO: 73165 - RNA, 30 nt, Artificial Sequence
  Centrosomal protein of 112 kDa (922-931)
gagcuggaagacaccaucagcucccucaag

SEQ ID NO: 73166 - RNA, 30 nt, Artificial Sequence
  Coatomer subunit epsilon (18-27)
gagcuguucgacgugaagaacgccuuuuac

SEQ ID NO: 73167 - RNA, 30 nt, Artificial Sequence
  Histone H2A deubiquitinase MYSM1 (25-34)
gagcuguucgaacagggccucgccaaguuu

SEQ ID NO: 73168 - RNA, 30 nt, Artificial Sequence
  General transcription factor II-I (326-335)
gagcuguucgaaagaaaguacgcccaggcu

SEQ ID NO: 73169 - RNA, 30 nt, Artificial Sequence
  Vacuolar protein sorting-associated protein 13A (890-899)
gagcuguuccacaaggacaucgaagccuuu

SEQ ID NO: 73170 - RNA, 36 nt, Artificial Sequence
  THO complex subunit 3 (40-51)
gagcuguucagaggccacagcaagaccagggaauuu

SEQ ID NO: 73171 - RNA, 27 nt, Artificial Sequence
  Integrator complex subunit 8 (283-291)
gagcugaucgccgaaauuggcagccuc

SEQ ID NO: 73172 - RNA, 33 nt, Artificial Sequence
  Influenza virus NS1A-binding protein (345-355)
gagcugaucgaaaagcccaugagcccuaugcag

SEQ ID NO: 73173 - RNA, 33 nt, Artificial Sequence
  Switch-associated protein 70 (177-187)
gagcugaucgaacucauuggcaacgggcaguuc

SEQ ID NO: 73174 - RNA, 27 nt, Artificial Sequence
  Uncharacterized protein C20orf96 (128-136)
gagcugaucgaaaccauucaggagaug

SEQ ID NO: 73175 - RNA, 33 nt, Artificial Sequence
  Derlin-1 (173-183)
gagcugaucggcaaccucguggggcaccuuuac

SEQ ID NO: 73176 - RNA, 33 nt, Artificial Sequence
  Endoplasmin (169-179)
gagcugaucggccaguucggggugggauuuuac

SEQ ID NO: 73177 - RNA, 30 nt, Artificial Sequence
  High affinity cationic amino acid transporter 1 (138-147)
gagcugaucggcagacccauuggggaauuc

SEQ ID NO: 73178 - RNA, 27 nt, Artificial Sequence
  F-BAR domain only protein 2 (94-102)
gagcugaucaaggaagugcagaaauac

SEQ ID NO: 73179 - RNA, 27 nt, Artificial Sequence
  Regulatory-associated protein of mTOR (80-88)
gagcugaucaacaauauuaaguacuau

SEQ ID NO: 73180 - RNA, 27 nt, Artificial Sequence
  Heat shock protein HSP 90-alpha (498-506)
gagcugauccccgaauaccucaacuuc

SEQ ID NO: 73181 - RNA, 24 nt, Artificial Sequence
  ATP-dependent DNA helicase Q1 (34-41)
gagcugauccagaagaaaaaggug

SEQ ID NO: 73182 - RNA, 27 nt, Artificial Sequence
  LisH domain-containing protein FOPNL (55-63)
gagcugaucagagaauaccucgaguuc

SEQ ID NO: 73183 - RNA, 27 nt, Artificial Sequence
  Condensin complex subunit 1 (994-1002)
gagcugaucagaggcauuugcgaaaug

SEQ ID NO: 73184 - RNA, 27 nt, Artificial Sequence
  Inositol-tetrakisphosphate 1-kinase (111-119)
gagcugaucagaaagauugaagccuac

SEQ ID NO: 73185 - RNA, 27 nt, Artificial Sequence
  Probable ubiquitin carboxyl-terminal hydrolase FAF-X (1964-1972)
gagcugaucagauacauuagcgaacuc

SEQ ID NO: 73186 - RNA, 27 nt, Artificial Sequence
  Cyclin-dependent kinase 17 (448-456)
gagcugaucaccaaguuccuccaguac

SEQ ID NO: 73187 - RNA, 33 nt, Artificial Sequence
  AP-1 complex subunit sigma-1A (76-86)
gagcugaucacccucgaacuuauucacagauac

SEQ ID NO: 73188 - RNA, 27 nt, Artificial Sequence
  Ras GTPase-activating protein-binding protein 1 (355-363)
gagcugaaggacuucuuucagagcuac

SEQ ID NO: 73189 - RNA, 27 nt, Artificial Sequence
  Polypeptide N-acetylgalactosaminyltransferase 18 (200-208)
gagcugaaggaaaaacucaccgaguac

SEQ ID NO: 73190 - RNA, 27 nt, Artificial Sequence
  Zinc finger CCCH domain-containing protein 13 (909-917)
gagcugaaggaaaaagugagcuccguc

SEQ ID NO: 73191 - RNA, 27 nt, Artificial Sequence
  Ankyrin repeat and LEM domain-containing protein 2 (463-471)
gagcugaaggaaagaaucagggaguac

SEQ ID NO: 73192 - RNA, 27 nt, Artificial Sequence
  Histone-lysine N-methyltransferase SUV420H1 (136-144)
gagcugaaggaagugaucgagagauuc

SEQ ID NO: 73193 - RNA, 27 nt, Artificial Sequence
  Glyceraldehyde-3-phosphate dehydrogenase, testis-specific (295-303)
gagcugaagggcaaacucaccgggaug

SEQ ID NO: 73194 - RNA, 27 nt, Artificial Sequence
  Periphilin-1 (355-363)
gagcugaagcacuucaucgccgaauac

SEQ ID NO: 73195 - RNA, 27 nt, Artificial Sequence
  Probable ATP-dependent RNA helicase DDX46 (184-192)
gagcugaagaaagaaaucgaggaaaug

SEQ ID NO: 73196 - RNA, 27 nt, Artificial Sequence
  Serine/threonine-protein kinase Nek2 (90-98)
gagcugaagcucaaagaaauccagcuu

SEQ ID NO: 73197 - RNA, 27 nt, Artificial Sequence
  Golgin subfamily A member 4 (1075-1083)
gagcugaagcagaaaauccuccuuuuc

SEQ ID NO: 73198 - RNA, 27 nt, Artificial Sequence
  CAP-Gly domain-containing linker protein 1 (612-620)
gagcugaagacccagaucgaaaaaaug

SEQ ID NO: 73199 - RNA, 36 nt, Artificial Sequence
  Stromal cell-derived factor 2 (200-211)
gagcugcucaaggccgaagcucaccaugcagagcuu

SEQ ID NO: 73200 - RNA, 24 nt, Artificial Sequence
  Heat shock protein 105 kDa (312-319)
gagcugcuccagaagaucgaagug

SEQ ID NO: 73201 - RNA, 33 nt, Artificial Sequence
  26S proteasome non-ATPase regulatory subunit 6 (212-222)
gagcugauggacuacaagaccuucgugacauau

SEQ ID NO: 73202 - RNA, 30 nt, Artificial Sequence; identical to SEQ ID NO: 48975
  Centrosomal protein CEP57L1 (4-13)

SEQ ID NO: 73203 - RNA, 30 nt, Artificial Sequence
  ATP-dependent RNA helicase DDX18 (213-222)
gagcugaugacccaccaugugcacacauac

SEQ ID NO: 73204 - RNA, 30 nt, Artificial Sequence
  Puromycin-sensitive aminopeptidase (151-160)
gagcugaacgacaagaugaaaggcuucuac

SEQ ID NO: 73205 - RNA, 27 nt, Artificial Sequence
  Vimentin (109-117)
gagcugaacgacagauucgccaauuac

SEQ ID NO: 73206 - RNA, 27 nt, Artificial Sequence
  Serine/threonine-protein kinase Nek2 (28-36)
gagcugaacgaaaucauuaccagaaug

SEQ ID NO: 73207 - RNA, 27 nt, Artificial Sequence
  Semaphorin-4C (385-393)
gagcugcccgacaacauccucaauuuc

SEQ ID NO: 73208 - RNA, 27 nt, Artificial Sequence
  RNA polymerase II elongation factor ELL2 (524-532)
gagcugcccgacuaccucaucaaguau

SEQ ID NO: 73209 - RNA, 24 nt, Artificial Sequence
  Zinc finger CCCH domain-containing protein 4 (417-424)
gagcugcccaagaaaagagaacuc

SEQ ID NO: 73210 - RNA, 27 nt, Artificial Sequence
  Nuclear pore complex protein Nup205 (523-531)
gagcugcagggccacaucgggagauuc

SEQ ID NO: 73211 - RNA, 30 nt, Artificial Sequence
  Alpha-enolase (15-24)
gagcugagagacaacgauaagaccagguac

SEQ ID NO: 73212 - RNA, 27 nt, Artificial Sequence
  TAR DNA-binding protein 43 (206-214)
gagcugagagaauucuuuagccaguac

SEQ ID NO: 73213 - RNA, 27 nt, Artificial Sequence
  Serine/threonine-protein kinase TAO3 (456-464)
gagcugagagaacagaugagcggcuac

SEQ ID NO: 73214 - RNA, 27 nt, Artificial Sequence
  Rho guanine nucleotide exchange factor 2 (258-266)
gagcugagcgacauccacaccagauuc

SEQ ID NO: 73215 - RNA, 27 nt, Artificial Sequence
  dCTP pyrophosphatase 1 (95-103)
gagcugagcgacgugcucaucuaccuu

SEQ ID NO: 73216 - RNA, 27 nt, Artificial Sequence
  Protein phosphatase 1 regulatory subunit 12A (956-964)
gagcugaccgaccucaagcuucagcug

SEQ ID NO: 73217 - RNA, 33 nt, Artificial Sequence
  Clustered mitochondria protein homolog (607-617)
gagcugguggacgccuucgucgaacacagauac

SEQ ID NO: 73218 - RNA, 27 nt, Artificial Sequence
  Splicing factor 3B subunit 2 (26-34)
gagcugguggaaagacuccagagcuac

SEQ ID NO: 73219 - RNA, 36 nt, Artificial Sequence; identical to SEQ ID NO: 48992
  F-box only protein 34 (410-421)

SEQ ID NO: 73220 - RNA, 27 nt, Artificial Sequence
  Inositol-tetrakisphosphate 1-kinase (76-84)
gagcuggugcacagauuccaggaauac

SEQ ID NO: 73221 - RNA, 27 nt, Artificial Sequence
  Protein DEK (174-182)
gagcuggugaagagaauccucaacuuc

SEQ ID NO: 73222 - RNA, 30 nt, Artificial Sequence
  Sorting nexin-4 (344-353)
gagcuggugaccggcacagucagaacuuuc

SEQ ID NO: 73223 - RNA, 27 nt, Artificial Sequence
  DNA replication complex GINS protein PSF2 (13-21)
gagcuggugaccaucauucccaacuuc

SEQ ID NO: 73224 - RNA, 30 nt, Artificial Sequence
  U3 small nucleolar RNA-associated protein 15 homolog (362-371)
gagcuguacgacagagaucucaagcacuuc

SEQ ID NO: 73225 - RNA, 30 nt, Artificial Sequence
  Pumilio homolog 3 (274-283)
gagcuguacggcaacaccuuccagcucuau

SEQ ID NO: 73226 - RNA, 27 nt, Artificial Sequence
  TELO2-interacting protein 1 homolog (510-518)
gagcuguaccaccagagcguggucuau

SEQ ID NO: 73227 - RNA, 30 nt, Artificial Sequence
  Protein RRP5 homolog (1712-1721)
gagcuguacaacagaaugcucaagagguuc

SEQ ID NO: 73228 - RNA, 30 nt, Artificial Sequence
  Tetratricopeptide repeat protein 37 (950-959)
gagcuguaccaguauaacauccuccaaaug

SEQ ID NO: 73229 - RNA, 27 nt, Artificial Sequence
  Vacuolar fusion protein CCZ1 homolog (448-456)
gagcuguacgugauccucaaccagaag

SEQ ID NO: 73230 - RNA, 30 nt, Artificial Sequence
  Clathrin heavy chain 1 (1402-1411)
gagcuguacuauagagccauccaguucuac

SEQ ID NO: 73231 - RNA, 27 nt, Artificial Sequence
  Dedicator of cytokinesis protein 7 (167-175)
gagaugaaggacagaaucaccuacuuc

SEQ ID NO: 73232 - RNA, 27 nt, Artificial Sequence
  Kinetochore-associated protein DSN1 homolog (194-202)
gagaugaaggaauacaucaccaaauuc

SEQ ID NO: 73233 - RNA, 27 nt, Artificial Sequence
  Actin-related protein 5 (513-521)
gagaugagacccuucaggagcuccuuu

SEQ ID NO: 73234 - RNA, 33 nt, Artificial Sequence
  5,6-dihydroxyindole-2-carboxylic acid oxidase (428-438)
gagaacgcccccaucggccacaauagacaguac

SEQ ID NO: 73235 - RNA, 33 nt, Artificial Sequence
  Eukaryotic translation initiation factor 3 subunit L (295-305)
gagaacaucgaacugaauaagaaaagcauguac

SEQ ID NO: 73236 - RNA, 27 nt, Artificial Sequence
  Inositol-3-phosphate synthase 1 (246-254)
gagaaccugcucagaaccaucgaacuu

SEQ ID NO: 73237 - RNA, 27 nt, Artificial Sequence
  15-hydroxyprostaglandin dehydrogenase (NAD(+)) (198-206)
gagaacaugggccaguacaucgaauau

SEQ ID NO: 73238 - RNA, 27 nt, Artificial Sequence
  Mitogen-activated protein kinase 8 (261-269)
gagaacagacccaaguacgccggcuau

SEQ ID NO: 73239 - RNA, 27 nt, Artificial Sequence
  THO complex subunit 1 (70-78)
gagaacgugcuggccaucauuagccuc

SEQ ID NO: 73240 - RNA, 30 nt, Artificial Sequence
  Protein-methionine sulfoxide oxidase MICAL1 (261-270)
gagcagcaccccggcgacgggcauuucuac

SEQ ID NO: 73241 - RNA, 27 nt, Artificial Sequence
  Gamma-tubulin complex component 2 (486-494)
gagcagaucgaaaaggccuucaacuac

SEQ ID NO: 73242 - RNA, 27 nt, Artificial Sequence
  Dual specificity protein phosphatase 19 (169-177)
gagcagaccagcuucacauccgccuuu

SEQ ID NO: 73243 - RNA, 27 nt, Artificial Sequence
  Semaphorin-4C (402-410)
gagcaggugggccccagauggagcagg

SEQ ID NO: 73244 - RNA, 27 nt, Artificial Sequence
  Eukaryotic translation initiation factor 3 subunit A (577-585)
gagagaaaggaaaggcuggagagccuc

SEQ ID NO: 73245 - RNA, 27 nt, Artificial Sequence
  Protein enabled homolog (159-167)
gagagacuggaaaggcaggagcggcuc

SEQ ID NO: 73246 - RNA, 24 nt, Artificial Sequence
  Endoplasmin (719-726)
gagagaaugcugaggcucagccuu

SEQ ID NO: 73247 - RNA, 27 nt, Artificial Sequence
  Nuclear factor NF-kappa-B p100 subunit (588-596)
gagagacagggcgggaggaccgcccug

SEQ ID NO: 73248 - RNA, 27 nt, Artificial Sequence
  Dual specificity protein phosphatase 4 (110-118)
gagagaagccccagggccgaaucccug

SEQ ID NO: 73249 - RNA, 27 nt, Artificial Sequence
  Zinc finger protein 264 (382-390)
gagagcgccgcucugauccaccauuac

SEQ ID NO: 73250 - RNA, 27 nt, Artificial Sequence
  Histone acetyltransferase p300 (621-629)
gagagcgccaacaauagagcugaauac

SEQ ID NO: 73251 - RNA, 33 nt, Artificial Sequence
  Glutamine and serine-rich protein 1 (139-149)
gagagcgccccccaccugcuccagccucaauuc

SEQ ID NO: 73252 - RNA, 30 nt, Artificial Sequence
  Chromodomain-helicase-DNA-binding protein 9 (1356-1365)
gagagcgccuacauccugcagggcggguau

SEQ ID NO: 73253 - RNA, 30 nt, Artificial Sequence
  Protein fem-1 homolog B (29-38)
gagagcgacaucagauaccugcucggcuau

SEQ ID NO: 73254 - RNA, 33 nt, Artificial Sequence
  ER membrane protein complex subunit 1 (169-179)
gagagcgacuccauccacuaccagaugguguau

SEQ ID NO: 73255 - RNA, 30 nt, Artificial Sequence
  Prolyl endopeptidase FAP (88-97)
gagagcgacuacuccaagcuguggagauau

SEQ ID NO: 73256 - RNA, 30 nt, Artificial Sequence
  28S ribosomal protein S18b, mitochondrial (60-69)
gagagcgaagaguaccaggaaagauauggc

SEQ ID NO: 73257 - RNA, 36 nt, Artificial Sequence
  CD109 antigen (1076-1087)
gagagcgaauucuccagaggcaucucugacaacuac

SEQ ID NO: 73258 - RNA, 24 nt, Artificial Sequence
  Asparagine synthetase (glutamine-hydrolyzing) (389-396)
gagagcgaaagacugcucagggag

SEQ ID NO: 73259 - RNA, 30 nt, Artificial Sequence
  Serine/threonine-protein kinase Nek3 (67-76)
gagagcuucgaagccgagggccaccuguac

SEQ ID NO: 73260 - RNA, 27 nt, Artificial Sequence
  Sestrin-3 (9-17)
gagagcuuccugagaucccaguuuuac

SEQ ID NO: 73261 - RNA, 33 nt, Artificial Sequence
  Torsin-1A-interacting protein 2 (368-378)
gagagcuuccccgccggcuccacccugaucuuu

SEQ ID NO: 73262 - RNA, 36 nt, Artificial Sequence
  Torsin-1A-interacting protein 2 (368-379)
gagagcuuccccgccggcuccacccugaucuuuuac

SEQ ID NO: 73263 - RNA, 30 nt, Artificial Sequence
  Cell division cycle-associated protein 7 (137-146)
gagagcuuccccggcuccuuuagagggagg

SEQ ID NO: 73264 - RNA, 36 nt, Artificial Sequence
  Putative elongation factor 1-alpha-like 3 (413-424)
gagagcuucuccgacuaccccccucugggcagauuu

SEQ ID NO: 73265 - RNA, 30 nt, Artificial Sequence
  Dual specificity protein kinase TTK (197-206)
gagagcuucuccggcucucuggggcaccuc

SEQ ID NO: 73266 - RNA, 27 nt, Artificial Sequence
  ER degradation-enhancing alpha-mannosidase-like protein 2 (361-369)
gagagcaucgaaaagauuuccaaagug

SEQ ID NO: 73267 - RNA, 33 nt, Artificial Sequence
  E3 ubiquitin-protein ligase HECTD1 (531-541)
gagagcaucgaaagacugccccuccaccuuuac

SEQ ID NO: 73268 - RNA, 27 nt, Artificial Sequence
  Zinc-binding alcohol dehydrogenase domain-containing protein 2 (347-355)
gagagcaucuucagagccgugaacuac

SEQ ID NO: 73269 - RNA, 30 nt, Artificial Sequence
  GATA zinc finger domain-containing protein 1 (140-149)
gagagcaucuucuacaagggcguguauuac

SEQ ID NO: 73270 - RNA, 27 nt, Artificial Sequence
  Abnormal spindle-like microcephaly-associated protein (62-70)
gagagcauccugaccauucagaaguac

SEQ ID NO: 73271 - RNA, 39 nt, Artificial Sequence
  Ceramide synthase 4 (291-303)
gagagcaucuccaacagaggccccuucuuuggguacuau

SEQ ID NO: 73272 - RNA, 39 nt, Artificial Sequence
  Leucine-rich repeat-containing protein 9 (566-578)
gagagcaucucccagucuaacuaccccauggugaauuca

SEQ ID NO: 73273 - RNA, 30 nt, Artificial Sequence
  Cytochrome b5 domain-containing protein 1 (157-166)
gagagcaucugggaaauucugcacagauac

SEQ ID NO: 73274 - RNA, 27 nt, Artificial Sequence
  Poly (ADP-ribose) polymerase 9 (164-172)
gagagcaagcaguucguggccagauac

SEQ ID NO: 73275 - RNA, 27 nt, Artificial Sequence
  Coiled-coil domain-containing protein 158 (458-466)
gagagccuggaaaagguguccucucuc

SEQ ID NO: 73276 - RNA, 33 nt, Artificial Sequence
  Leucine-rich repeat-containing protein 57 (51-61)
gagagccugcccccucuccuuaucggcaaguuc

SEQ ID NO: 73277 - RNA, 30 nt, Artificial Sequence
  N-acetylglucosamine-1-phosphotransferase subunits alpha/beta (1173-1182)
gagagcauguuccccaucccuucccaguuu

SEQ ID NO: 73278 - RNA, 33 nt, Artificial Sequence
  Protein disulfide-isomerase A3 (36-46)
gagagcagaaucuccgacaccggcucugccggg

SEQ ID NO: 73279 - RNA, 27 nt, Artificial Sequence
  BRCA1-A complex subunit BRE (134-142)
gagagcuccagacugauguucgaauac

SEQ ID NO: 73280 - RNA, 27 nt, Artificial Sequence
  Protein FAM135A (825-833)
gagagcaccuccgccaucucugaaauu

SEQ ID NO: 73281 - RNA, 27 nt, Artificial Sequence
  Transcriptional enhancer factor TEF-1 (240-248)
gagagcguggacaucagacagauuuac

SEQ ID NO: 73282 - RNA, 30 nt, Artificial Sequence
  OTU domain-containing protein 7B (579-588)
gagagcgugggcaacgggggauccaaguac

SEQ ID NO: 73283 - RNA, 27 nt, Artificial Sequence
  Scm-like with four MBT domains protein 1 (492-500)
gagagcgugaugaucaacggcaaguac

SEQ ID NO: 73284 - RNA, 27 nt, Artificial Sequence
  Tensin-1 (839-847)
gagagcgugcccccuggcagauccuac

SEQ ID NO: 73285 - RNA, 30 nt, Artificial Sequence
  Zinc transporter ZIP6 (242-251)
gagagcguguccgaacccagaaagggcuuc

SEQ ID NO: 73286 - RNA, 30 nt, Artificial Sequence
  26S proteasome non-ATPase regulatory subunit 6 (309-318)
gagagcuacagaucccugacccucggcuau

SEQ ID NO: 73287 - RNA, 30 nt, Artificial Sequence
  Exonuclease 1 (584-593)
gagagcuacuccuucgaaucuucaaaguuu

SEQ ID NO: 73288 - RNA, 24 nt, Artificial Sequence
  Lactosylceramide alpha-2,3-sialyltransferase (260-267)
gagaccgccuucgacauccugcag

SEQ ID NO: 73289 - RNA, 33 nt, Artificial Sequence
  Transcription factor SOX-10 (359-369)
gagaccgccggcccccaggggccuccacacuac

SEQ ID NO: 73290 - RNA, 27 nt, Artificial Sequence
  DNA-directed RNA polymerases I, II, and III subunit RPABC1 (198-206)
gagaccgccggcagauacaucacauau

SEQ ID NO: 73291 - RNA, 36 nt, Artificial Sequence
  HLA class I histocompatibility antigen, A-66 alpha chain (147-158)
gagaccgcccacgaagcugagcaguggagagcauac

SEQ ID NO: 73292 - RNA, 30 nt, Artificial Sequence
  Actin-related protein 3 (171-180)
gagaccgccaaggcugugaaagaaagauac

SEQ ID NO: 73293 - RNA, 33 nt, Artificial Sequence
  Protein S100-A1 (6-16)
gagaccgccauggaaacacugaucaacguguuc

SEQ ID NO: 73294 - RNA, 33 nt, Artificial Sequence
  ATP-binding cassette sub-family E member 1 (335-345)
gagaccgccaacgaagaggaagugaagaaaaug

SEQ ID NO: 73295 - RNA, 30 nt, Artificial Sequence
  YLP motif-containing protein 1 (228-237)
gagaccgcccccagacacaugaugaggcug

SEQ ID NO: 73296 - RNA, 33 nt, Artificial Sequence
  Ataxin-10 (40-50)
gagaccgcccccagaacaaucuuccagagggug

SEQ ID NO: 73297 - RNA, 27 nt, Artificial Sequence
  Protein cordon-bleu (683-691)
gagaccgcccccagagugacaagcuuc

SEQ ID NO: 73298 - RNA, 27 nt, Artificial Sequence
  Alpha-1,3-mannosyl-glycoprotein 2-beta-N-acetylglucosaminyltransferase (147-155)
gagaccgcccaggcuaucgcaagcuac

SEQ ID NO: 73299 - RNA, 27 nt, Artificial Sequence
  Exocyst complex component 8 (72-80)
gagaccgccagagaaaucagcuaccug

SEQ ID NO: 73300 - RNA, 27 nt, Artificial Sequence
  Tudor domain-containing protein 7 (5-13)
gagaccgccagaaucgcucagcuggug

SEQ ID NO: 73301 - RNA, 30 nt, Artificial Sequence
  Spectrin beta chain, non-erythrocytic 1 (1262-1271)
gagaccgccagcgaacugcucaugagacuu

SEQ ID NO: 73302 - RNA, 30 nt, Artificial Sequence
  E3 ubiquitin-protein ligase RNF213 (3983-3992)
gagaccgccagcaagacacuguccagauuc

SEQ ID NO: 73303 - RNA, 33 nt, Artificial Sequence
  Kinesin-like protein KIF2C (317-327)
gagaccgccagcaacgaaguggucuacagauuc

SEQ ID NO: 73304 - RNA, 27 nt, Artificial Sequence
  Protein furry homolog-like (371-379)
gagaccgccagcagaaucgcuaaggug

SEQ ID NO: 73305 - RNA, 27 nt, Artificial Sequence
  Endoplasmin (698-706)
gagaccgccacacugagaagcggcuac

SEQ ID NO: 73306 - RNA, 33 nt, Artificial Sequence
  2'-5'-oligoadenylate synthase 1 (355-365)
gagaccgacgaucccagaagguaccagaaguau

SEQ ID NO: 73307 - RNA, 27 nt, Artificial Sequence
  Putative pre-mRNA-splicing factor ATP-dependent RNA helicase DHX32 (324-332)
gagaccgaaaagagaugccagguguac

SEQ ID NO: 73308 - RNA, 42 nt, Artificial Sequence
  Sorting nexin-17 (7-20)
gagaccgaaagcagauccggcgacucugggggaucagccuac

SEQ ID NO: 73309 - RNA, 33 nt, Artificial Sequence
  Caldesmon (164-174)
gagaccgaaacagugacuaagagcuaccagaaa

SEQ ID NO: 73310 - RNA, 30 nt, Artificial Sequence
  Deoxyhypusine synthase (353-362)
gagaccuucgcccagaagauggacgcuuuu

SEQ ID NO: 73311 - RNA, 30 nt, Artificial Sequence
  Cytoplasmic dynein 1 heavy chain 1 (1934-1943)
gagaccuucgacuuucaggccaugggcaga

SEQ ID NO: 73312 - RNA, 33 nt, Artificial Sequence
  Protein FAM127B (29-39)
gagaccuucgacggcgauacagacagacugccc

SEQ ID NO: 73313 - RNA, 39 nt, Artificial Sequence
  Nicastrin (333-345)
gagaccuucgacuacaucggcagcuccagaaugguguau

SEQ ID NO: 73314 - RNA, 27 nt, Artificial Sequence
  CAAX prenyl protease 1 homolog (62-70)
gagaccuucgaaaagagcagacuguac

SEQ ID NO: 73315 - RNA, 33 nt, Artificial Sequence
  Ceramide glucosyltransferase (71-81)
gagaccuucuuugaacuggacuaccccaaguau

SEQ ID NO: 73316 - RNA, 30 nt, Artificial Sequence
  Mediator of RNA polymerase II transcription subunit 13-like (1814-1823)
gagaccuucggcgaagccagccagaaguac

SEQ ID NO: 73317 - RNA, 27 nt, Artificial Sequence
  Eukaryotic peptide chain release factor GTP-binding subunit ERF3A (465-473)
gagaccuucaaggacuuuccccagaug

SEQ ID NO: 73318 - RNA, 36 nt, Artificial Sequence
  Eukaryotic peptide chain release factor GTP-binding subunit ERF3A (465-476)
gagaccuucaaggacuuuccccagaugggcagauuc

SEQ ID NO: 73319 - RNA, 30 nt, Artificial Sequence
  Kv channel-interacting protein 4 isoform 5 (81-90)
gagaccuucaaggaaaucuacagccaguuu

SEQ ID NO: 73320 - RNA, 30 nt, Artificial Sequence
  Dephospho-CoA kinase domain-containing protein (98-107)
gagaccuucaaguacuuucugagaggcuau

SEQ ID NO: 73321 - RNA, 33 nt, Artificial Sequence; identical to SEQ ID NO: 49094
  Proteasome-associated protein ECM29 homolog (349-359)

SEQ ID NO: 73322 - RNA, 30 nt, Artificial Sequence
  Telomeric repeat-binding factor 2 (175-184)
gagaccuuccagcaaaagaugcugagauuu

SEQ ID NO: 73323 - RNA, 27 nt, Artificial Sequence
  E3 ubiquitin-protein ligase RNF213 (2162-2170)
gagaccuuccagagacccuaccaauau

SEQ ID NO: 73324 - RNA, 30 nt, Artificial Sequence
  Uncharacterized protein C7orf43 (200-209)
gagaccuucagaggcgaacagagcgccuuu

SEQ ID NO: 73325 - RNA, 30 nt, Artificial Sequence
  40S ribosomal protein S7 (169-178)
gagaccuucagcggcguguacaagaaacug

SEQ ID NO: 73326 - RNA, 27 nt, Artificial Sequence
  Protein SGT1 homolog (78-86)
gagaccuucacagaaggccagaagcug

SEQ ID NO: 73327 - RNA, 27 nt, Artificial Sequence
  Mitotic spindle assembly checkpoint protein MAD2A (41-49)
gagaccuucacaagagugcagaaguac

SEQ ID NO: 73328 - RNA, 30 nt, Artificial Sequence; identical to SEQ ID NO: 49101
  Src substrate cortactin (75-84)

SEQ ID NO: 73329 - RNA, 33 nt, Artificial Sequence
  Tetratricopeptide repeat protein 17 (861-871)
gagaccggccagaucgaaaacgggcacagauac

SEQ ID NO: 73330 - RNA, 27 nt, Artificial Sequence
  Inositol 1,4,5-trisphosphate receptor type 2 (1301-1309)
gagacccacggcagacauguggaauac

SEQ ID NO: 73331 - RNA, 27 nt, Artificial Sequence
  L-dopachrome tautomerase (196-204)
gagacccaccugagcuccaagagauac

SEQ ID NO: 73332 - RNA, 33 nt, Artificial Sequence
  Nucleoside diphosphate kinase homolog 5 (107-117)
gagacccaccccgacagccugagagccaucuac

SEQ ID NO: 73333 - RNA, 30 nt, Artificial Sequence
  Conserved oligomeric Golgi complex subunit 4 (61-70)
gagacccaccagcccaucguggaaacauac

SEQ ID NO: 73334 - RNA, 30 nt, Artificial Sequence
  Nuclear autoantigenic sperm protein (246-255)
gagacccacuaccagcugggccucgccuau

SEQ ID NO: 73335 - RNA, 27 nt, Artificial Sequence
  Glutamine-fructose-6-phosphate aminotransferase (isomerizing) 1 (27-35)
gagaccaucgccaagcuggugaaauac

SEQ ID NO: 73336 - RNA, 36 nt, Artificial Sequence
  Splicing factor 3A subunit 2 (36-47)
gagaccaucgacauuaacaaggaucccuacuucaug

SEQ ID NO: 73337 - RNA, 27 nt, Artificial Sequence
  Alpha-aminoadipic semialdehyde synthase, mitochondrial (614-622)
gagaccaucgacaaggccaaagaagug

SEQ ID NO: 73338 - RNA, 30 nt, Artificial Sequence
  HEAT repeat-containing protein 5B (1515-1524)
gagaccaucgacacagccagacugcacuac

SEQ ID NO: 73339 - RNA, 33 nt, Artificial Sequence
  Methylsterol monooxygenase 1 (92-102)
gagaccaucgacgugcacagcggcuacgauauu

SEQ ID NO: 73340 - RNA, 27 nt, Artificial Sequence
  Threonine-tRNA ligase, cytoplasmic (692-700)
gagaccaucgaaagacugcagcaacuc

SEQ ID NO: 73341 - RNA, 27 nt, Artificial Sequence
  TBC1 domain family member 10A (329-337)
gagaccaucgaaagacugaggagccuc

SEQ ID NO: 73342 - RNA, 39 nt, Artificial Sequence
  GRIP and coiled-coil domain-containing protein 1 (19-31)
gagaccaucgaaacacagaagaaacaacugcuccaguac

SEQ ID NO: 73343 - RNA, 27 nt, Artificial Sequence
  DNA-directed RNA polymerase III subunit RPC3 (517-525)
gagaccaucuuccugcucgaaagcuac

SEQ ID NO: 73344 - RNA, 27 nt, Artificial Sequence
  Dynamin-like 120 kDa protein, mitochondrial (435-443)
gagaccaucuucagcauuuccaaggcc

SEQ ID NO: 73345 - RNA, 33 nt, Artificial Sequence
  Regulatory-associated protein of mTOR (100-110)
gagaccaucggcgccaaccugcagaagcaauac

SEQ ID NO: 73346 - RNA, 27 nt, Artificial Sequence
  Heterogeneous nuclear ribonucleoprotein K (95-103)
gagaccaucggcgaaauucugaagaaa

SEQ ID NO: 73347 - RNA, 27 nt, Artificial Sequence
  X-ray repair cross-complementing protein 5 (17-25)
gagaccaucggcaagaaauucgaaaag

SEQ ID NO: 73348 - RNA, 36 nt, Artificial Sequence
  Superkiller viralicidic activity 2-like 2 (269-280)
gagaccaucauucugcuccccgacaacgugcacuac

SEQ ID NO: 73349 - RNA, 33 nt, Artificial Sequence
  Golgi-specific brefeldin A-resistance guanine nucleotide exchange factor 1 (948-958)
gagaccaucauucagaaggccauaagcggcuuc

SEQ ID NO: 73350 - RNA, 30 nt, Artificial Sequence
  Inositol polyphosphate multikinase (205-214)
gagaccaucaaggacggcgugagcagauuc

SEQ ID NO: 73351 - RNA, 30 nt, Artificial Sequence
  Cyclin-dependent kinase 4 (41-50)
gagaccaucaaggaccugaugagacaguuc

SEQ ID NO: 73352 - RNA, 36 nt, Artificial Sequence
  Ral GTPase-activating protein subunit beta (590-601)
gagaccauccugcccgacagagaacucagcaaguuc

SEQ ID NO: 73353 - RNA, 30 nt, Artificial Sequence
  Mitochondrial Rho GTPase 1 (129-138)
gagaccauccugcccauuaugaaccaguac

SEQ ID NO: 73354 - RNA, 27 nt, Artificial Sequence
  Sodium-dependent neutral amino acid transporter B(0)AT2 (81-89)
gagaccaucaugaaguuccugaaaaug

SEQ ID NO: 73355 - RNA, 27 nt, Artificial Sequence
  Rab GDP dissociation inhibitor beta (124-132)
gagaccaucaacagaauuaagcuguac

SEQ ID NO: 73356 - RNA, 27 nt, Artificial Sequence
  cAMP-specific 3',5'-cyclic phosphodiesterase 4B (104-112)
gagaccauccagacauacagaagcgug

SEQ ID NO: 73357 - RNA, 30 nt, Artificial Sequence; identical to SEQ ID NO: 49130
  Platelet-derived growth factor D (54-63)

SEQ ID NO: 73358 - RNA, 27 nt, Artificial Sequence
  Vacuolar protein-sorting-associated protein 36 (204-212)
gagaccaucagauucaagagcuaccug

SEQ ID NO: 73359 - RNA, 27 nt, Artificial Sequence
  Transmembrane protein 260 (666-674)
gagaccaucagacacuucaggcuguac

SEQ ID NO: 73360 - RNA, 30 nt, Artificial Sequence
  Probable ATP-dependent RNA helicase DDX41 (307-316)
gagaccaucagacacggcgugcauaugaug

SEQ ID NO: 73361 - RNA, 27 nt, Artificial Sequence
  Lysophospholipid acyltransferase 7 (297-305)
gagaccaucagaaacauugacugcuac

SEQ ID NO: 73362 - RNA, 27 nt, Artificial Sequence
  HAUS augmin-like complex subunit 2 (20-28)
gagaccaucagaaacauuccccaccug

SEQ ID NO: 73363 - RNA, 30 nt, Artificial Sequence
  Dynamin-2 (654-663)
gagaccaucagaaaccugguggacagcuac

SEQ ID NO: 73364 - RNA, 27 nt, Artificial Sequence
  Basic leucine zipper and W2 domain-containing protein 2 (106-114)
gagaccaucagaaacuacgcccaggug

SEQ ID NO: 73365 - RNA, 27 nt, Artificial Sequence
  T-complex protein 1 subunit alpha (15-23)
gagaccaucagaagccagaacgugaug

SEQ ID NO: 73366 - RNA, 27 nt, Artificial Sequence
  Zinc finger FYVE domain-containing protein 16 (802-810)
gagaccaucagcaaggcccaggcuuuc

SEQ ID NO: 73367 - RNA, 27 nt, Artificial Sequence
  dTDP-D-glucose 4,6-dehydratase (30-38)
gagaccaucagcaacaagcagaauuac

SEQ ID NO: 73368 - RNA, 36 nt, Artificial Sequence
  Lysosomal glucocerebrosidase (500-511)
gagaccaucagccccggcuacuccauucacacauau

SEQ ID NO: 73369 - RNA, 27 nt, Artificial Sequence
  Delta(14)-sterol reductase (327-335)
gagaccaucagcacagccacuggcaga

SEQ ID NO: 73370 - RNA, 33 nt, Artificial Sequence
  UDP-N-acetylhexosamine pyrophosphorylase (460-470)
gagaccaucacagccgacgugaaccacaaucug

SEQ ID NO: 73371 - RNA, 27 nt, Artificial Sequence
  THO complex subunit 2 (857-865)
gagaccaucacaaaguuccugcagcuc

SEQ ID NO: 73372 - RNA, 33 nt, Artificial Sequence
  S-phase kinase-associated protein 2 (283-293)
gagaccaucacacagcugaaccucagcggcuac

SEQ ID NO: 73373 - RNA, 33 nt, Artificial Sequence
  Minor histocompatibility antigen H13 (68-78)
gagaccaucacaagcagagacgccgcuagguuc

SEQ ID NO: 73374 - RNA, 27 nt, Artificial Sequence
  DNA repair protein complementing XP-A cells (180-188)
gagaccaucgugcaccagcaugaauac

SEQ ID NO: 73375 - RNA, 27 nt, Artificial Sequence
  Disco-interacting protein 2 homolog B (143-151)
gagaccaucgugaacguccuggacuuc

SEQ ID NO: 73376 - RNA, 30 nt, Artificial Sequence
  Tumor suppressor candidate 2 (66-75)
gagaccaucgugacaaagaacggccagaaa

SEQ ID NO: 73377 - RNA, 30 nt, Artificial Sequence
  RuvB-like 2 (169-178)
gagaccaucuacgaccugggcacaaagaug

SEQ ID NO: 73378 - RNA, 33 nt, Artificial Sequence
  Mediator of RNA polymerase II transcription subunit 23 (553-563)
gagaccaucuacggcaacgggauuaugagaaua

SEQ ID NO: 73379 - RNA, 27 nt, Artificial Sequence
  Peroxisome biogenesis factor 1 (491-499)
gagaccaaggacggccugaaagaauuc

SEQ ID NO: 73380 - RNA, 27 nt, Artificial Sequence
  F-box only protein 38 (25-33)
gagaccaaggacuacaugaaccagcug

SEQ ID NO: 73381 - RNA, 33 nt, Artificial Sequence
  Destrin (90-100)
gagaccaaggaaagcagaaaagaggaacugaug

SEQ ID NO: 73382 - RNA, 27 nt, Artificial Sequence
  Dynein light chain 1, cytoplasmic (69-77)
gagaccaagcacuucaucuacuuuuau

SEQ ID NO: 73383 - RNA, 27 nt, Artificial Sequence
  ATP-dependent RNA helicase DDX50 (83-91)
gagaccaagaaaaacgugacagaaaug

SEQ ID NO: 73384 - RNA, 27 nt, Artificial Sequence
  Protein LTV1 homolog (235-243)
gagaccaagagcagauucacagaauac

SEQ ID NO: 73385 - RNA, 27 nt, Artificial Sequence
  UPF0462 protein C4orf33 (111-119)
gagaccaagugggaaggcaaagccuac

SEQ ID NO: 73386 - RNA, 30 nt, Artificial Sequence
  Alpha-centractin (232-241)
gagacccuggaaacagagaaggcccaguac

SEQ ID NO: 73387 - RNA, 33 nt, Artificial Sequence
  Alpha-centractin (232-242)
gagacccuggaaacagagaaggcccaguacuau

SEQ ID NO: 73388 - RNA, 27 nt, Artificial Sequence
  Heterogeneous nuclear ribonucleoprotein L (557-565)
gagacccugggcuuccucaaccacuac

SEQ ID NO: 73389 - RNA, 30 nt, Artificial Sequence
  Truncated extracellular matrix protein 1 (208-217)
gagacccugaacuuccucgaaaucggcuac

SEQ ID NO: 73390 - RNA, 33 nt, Artificial Sequence
  HEAT repeat-containing protein 1 (1769-1779)
gagacccugccccacuucaucagcccuuaccuc

SEQ ID NO: 73391 - RNA, 27 nt, Artificial Sequence
  Neuron navigator 2 (931-939)
gagacccugcagagaaacacaagccuc

SEQ ID NO: 73392 - RNA, 30 nt, Artificial Sequence
  LIM domain-binding protein 3 (205-214)
gagacccugagagaaauggcccagauguac

SEQ ID NO: 73393 - RNA, 30 nt, Artificial Sequence
  Transient receptor potential cation channel subfamily M member 7 (239-248)
gagaccauggccaugaagcugcucacauac

SEQ ID NO: 73394 - RNA, 39 nt, Artificial Sequence
  Nucleoporin NUP188 homolog (30-42)
gagaccauggaccccuucguggauagaaucggcuacuuu

SEQ ID NO: 73395 - RNA, 39 nt, Artificial Sequence
  Aldehyde dehydrogenase family 1 member A3 (118-130)
gagaccauggacacaggcaagcccuuccugcacgccuuu

SEQ ID NO: 73396 - RNA, 33 nt, Artificial Sequence
  Myosin-10 (328-338)
gagaccauggaagccaugcacaucaugggcuuc

SEQ ID NO: 73397 - RNA, 30 nt, Artificial Sequence
  Heterogeneous nuclear ribonucleoprotein H (76-85)
gagaccaugggccacagauacguggaaguc

SEQ ID NO: 73398 - RNA, 27 nt, Artificial Sequence
  ETS-related transcription factor Elf-2 (173-181)
gagaccaugggcagagcccugagguac

SEQ ID NO: 73399 - RNA, 27 nt, Artificial Sequence
  Serine/threonine-protein phosphatase 4 regulatory subunit 2 (37-45)
gagaccaugauccaguggagccaauuc

SEQ ID NO: 73400 - RNA, 27 nt, Artificial Sequence
  Apolipoprotein E (84-92)
gagaccaugaaggaacugaaagccuac

SEQ ID NO: 73401 - RNA, 27 nt, Artificial Sequence
  Ribosome-recycling factor, mitochondrial (153-161)
gagaccaugaagcagaucaaacaauac

SEQ ID NO: 73402 - RNA, 30 nt, Artificial Sequence
  Interferon-induced protein with tetratricopeptide repeats 1 (375-384)
gagaccaugcaggacauccacuuccauuac

SEQ ID NO: 73403 - RNA, 33 nt, Artificial Sequence
  Inositol 1,4,5-trisphosphate receptor type 3 (1262-1272)
gagaccaugcagcacaucuuccugaacaauuac

SEQ ID NO: 73404 - RNA, 30 nt, Artificial Sequence
  TRPM8 channel-associated factor 1 (132-141)
gagaccaugacagaaaagcuggugaaauuc

SEQ ID NO: 73405 - RNA, 30 nt, Artificial Sequence
  Carnitine O-acetyltransferase (515-524)
gagaccaacgccgcuagacuggcacacuac

SEQ ID NO: 73406 - RNA, 27 nt, Artificial Sequence
  Trafficking kinesin-binding protein 2 (258-266)
gagaccaacgcccagaugagcagaaug

SEQ ID NO: 73407 - RNA, 27 nt, Artificial Sequence
  BTB/POZ domain-containing protein 3 (304-312)
gagaccaacgacaucuuccugugguac

SEQ ID NO: 73408 - RNA, 27 nt, Artificial Sequence
  Myotubularin (266-274)
gagaccaacaagcagaucagcaaacug

SEQ ID NO: 73409 - RNA, 36 nt, Artificial Sequence
  Serine-tRNA ligase, mitochondrial (334-345)
gagaccaacacaggccaggaacccagagggcuguac

SEQ ID NO: 73410 - RNA, 27 nt, Artificial Sequence
  E3 ubiquitin-protein ligase RFWD3 (353-361)
gagaccaacacagugguccagacuuac

SEQ ID NO: 73411 - RNA, 30 nt, Artificial Sequence
  Protein bicaudal D homolog 2 (309-318)
gagacccccaacagagugaugcuggacuac

SEQ ID NO: 73412 - RNA, 27 nt, Artificial Sequence
  Splicing factor, proline- and glutamine-rich (475-483)
gagacccccccuagauucgcccagcac

SEQ ID NO: 73413 - RNA, 30 nt, Artificial Sequence; identical to SEQ ID NO: 49186
  Histone-lysine N-methyltransferase 2C (4271-4280)

SEQ ID NO: 73414 - RNA, 33 nt, Artificial Sequence
  Tetratricopeptide repeat protein 4 (310-320)
gagacccccagcugggaccuggaacagaaguac

SEQ ID NO: 73415 - RNA, 27 nt, Artificial Sequence
  T-complex protein 1 subunit eta (146-154)
gagacccagaucggcggggaaagauac

SEQ ID NO: 73416 - RNA, 27 nt, Artificial Sequence
  Proteasome subunit alpha type-5 (37-45)
gagacccagaaccacugguucacauac

SEQ ID NO: 73417 - RNA, 30 nt, Artificial Sequence
  Zinc finger MIZ domain-containing protein 1 (308-317)
gagacccagaacaaggacaucaaucaauac

SEQ ID NO: 73418 - RNA, 27 nt, Artificial Sequence
  Histone-lysine N-methyltransferase NSD3 (50-58)
gagacccagacaaaguaccaaagcuau

SEQ ID NO: 73419 - RNA, 27 nt, Artificial Sequence
  Elongation factor 1-gamma (326-334)
gagacccagacacuggugagagaauac

SEQ ID NO: 73420 - RNA, 30 nt, Artificial Sequence
  Calcipressin-1 (27-36)
gagaccagagccaaguucgaaagccuguuu

SEQ ID NO: 73421 - RNA, 27 nt, Artificial Sequence
  Protein FAM184A (53-61)
gagaccagagaaaagauccugcaguac

SEQ ID NO: 73422 - RNA, 33 nt, Artificial Sequence
  Zinc finger protein 428 (46-56)
gagaccagagaacccgccgagacaggcggguac

SEQ ID NO: 73423 - RNA, 33 nt, Artificial Sequence
  Rho GTPase-activating protein 26 (401-411)
gagaccagaggcaucaacgaacaggggcuguac

SEQ ID NO: 73424 - RNA, 36 nt, Artificial Sequence
  A-kinase anchor protein 2 (904-915)
gagaccagacccgaaggcagcuacuucuccaaguau

SEQ ID NO: 73425 - RNA, 27 nt, Artificial Sequence
  Pre-mRNA-splicing regulator WTAP (228-236)
gagaccagacagcaacuggcccaguac

SEQ ID NO: 73426 - RNA, 27 nt, Artificial Sequence
  F-box/WD repeat-containing protein 11 (431-439)
gagaccagaagccccuccaggacauac

SEQ ID NO: 73427 - RNA, 33 nt, Artificial Sequence
  F-box/WD repeat-containing protein 11 (431-441)
gagaccagaagccccuccaggacauacacuuau

SEQ ID NO: 73428 - RNA, 27 nt, Artificial Sequence
  Zinc finger CCCH domain-containing protein 13 (597-605)
gagaccagaagcuccuaccccgaaagg

SEQ ID NO: 73429 - RNA, 36 nt, Artificial Sequence
  Zinc finger CCCH domain-containing protein 13 (597-608)
gagaccagaagcuccuaccccgaaagggaccgguau

SEQ ID NO: 73430 - RNA, 27 nt, Artificial Sequence
  Serine/threonine-protein kinase TBK1 (301-309)
gagaccagcgacauccugcacagaaug

SEQ ID NO: 73431 - RNA, 30 nt, Artificial Sequence
  Vimentin (457-466)
gagaccagccagcaccaugacgaucuggaa

SEQ ID NO: 73432 - RNA, 27 nt, Artificial Sequence
  Centromere protein F (880-888)
gagaccagccagagaaucuccaagcug

SEQ ID NO: 73433 - RNA, 33 nt, Artificial Sequence
  Peptidyl-glycine alpha-amidating monooxygenase (904-914)
gagaccagcuccggcagagugcuggggagguuc

SEQ ID NO: 73434 - RNA, 33 nt, Artificial Sequence
  Heterogeneous nuclear ribonucleoprotein A1 (24-34)
gagaccacagacgaaagccugagaucccacuuc

SEQ ID NO: 73435 - RNA, 27 nt, Artificial Sequence
  Exportin-7 (20-28)
gagaccacagacacuacgaccagacug

SEQ ID NO: 73436 - RNA, 27 nt, Artificial Sequence
  Poly (ADP-ribose) polymerase 4 (422-430)
gagaccacagaauuccugagcaagcuc

SEQ ID NO: 73437 - RNA, 30 nt, Artificial Sequence
  Flap endonuclease 1 (59-68)
gagaccacaagccaccugaugggcauguuc

SEQ ID NO: 73438 - RNA, 33 nt, Artificial Sequence
  Flap endonuclease 1 (59-69)
gagaccacaagccaccugaugggcauguucuac

SEQ ID NO: 73439 - RNA, 27 nt, Artificial Sequence
  Zinc finger MYM-type protein 3 (161-169)
gagaccacaagcaucgccacugcuaga

SEQ ID NO: 73440 - RNA, 27 nt, Artificial Sequence
  Transcription initiation factor TFIID subunit 4B (139-147)
gagaccacaagcaacaucacuuccaga

SEQ ID NO: 73441 - RNA, 27 nt, Artificial Sequence
  Uncharacterized protein C1orf112 (237-245)
gagaccacaacuagaaucagccugcuc

SEQ ID NO: 73442 - RNA, 27 nt, Artificial Sequence
  TM2 domain-containing protein 2 isoform b (68-76)
gagaccacaacuugggaaagaaaguac

SEQ ID NO: 73443 - RNA, 27 nt, Artificial Sequence
  Ubiquitin-like protein FUBI (19-27)
gagaccguggcccagaucaaggcucac

SEQ ID NO: 73444 - RNA, 27 nt, Artificial Sequence
  Dynactin subunit 1 (38-46)
gagaccgugggcgaccuggaagccaug

SEQ ID NO: 73445 - RNA, 33 nt, Artificial Sequence
  Interferon-induced GTP-binding protein Mx1 (394-404)
gagaccgugggcgaagaggacaucagacuguuc

SEQ ID NO: 73446 - RNA, 27 nt, Artificial Sequence
  Glycerol-3-phosphate acyltransferase 1, mitochondrial (479-487)
gagaccgugggcaaguucauccaguac

SEQ ID NO: 73447 - RNA, 27 nt, Artificial Sequence
  28S ribosomal protein S23, mitochondrial (7-15)
gagaccgugggcagcaucuucuccaga

SEQ ID NO: 73448 - RNA, 30 nt, Artificial Sequence
  Structural maintenance of chromosomes flexible hinge domain-containing protein 1 (89-98)
gagaccgugaaggacggcgucacacuguac

SEQ ID NO: 73449 - RNA, 27 nt, Artificial Sequence
  Phosphoprotein associated withosphingolipid-enriched microdomains 1 (182-190)
gagaccgugaaggaaaucaaagagguc

SEQ ID NO: 73450 - RNA, 30 nt, Artificial Sequence
  Developmentally-regulated GTP-binding protein 1 (203-212)
gagaccgugaagagcauccuggccgaauac

SEQ ID NO: 73451 - RNA, 27 nt, Artificial Sequence
  Ribosomal RNA small subunit methyltransferase NEP1 (48-56)
gagaccgugaaggucggcaaaacauac

SEQ ID NO: 73452 - RNA, 27 nt, Artificial Sequence
  ADP-ribosylation factor GTPase-activating protein 3 (388-396)
gagaccgugcugaagacaacuggcuac

SEQ ID NO: 73453 - RNA, 30 nt, Artificial Sequence
  Zinc finger protein 574 (7-16)
gagaccgugcuguacaucgaacacagauau

SEQ ID NO: 73454 - RNA, 33 nt, Artificial Sequence
  Ankyrin repeat and LEM domain-containing protein 2 (291-301)
gagaccgugaacaaggaaagagccaauagcuac

SEQ ID NO: 73455 - RNA, 30 nt, Artificial Sequence
  Absent in melanoma 1 protein (1522-1531)
gagaccgugaaccugagaagccucggcuuc

SEQ ID NO: 73456 - RNA, 27 nt, Artificial Sequence
  Rab GDP dissociation inhibitor alpha (74-82)
gagaccgugaacagaaucaagcuguac

SEQ ID NO: 73457 - RNA, 27 nt, Artificial Sequence
  Tumor susceptibility gene 101 protein (24-32)
gagaccgugaacgucaucacacuguac

SEQ ID NO: 73458 - RNA, 27 nt, Artificial Sequence
  Peroxisome proliferator-activated receptor delta (255-263)
gagaccgugagagaacugacagaguuc

SEQ ID NO: 73459 - RNA, 27 nt, Artificial Sequence
  Trafficking kinesin-binding protein 1 (346-354)
gagaccgugagaaacaucaaucagguc

SEQ ID NO: 73460 - RNA, 27 nt, Artificial Sequence
  T-complex protein 1 subunit delta (524-532)
gagaccgugagaagcauccugaagauu

SEQ ID NO: 73461 - RNA, 30 nt, Artificial Sequence
  Golgin subfamily A member 7 (45-54)
gagaccgugagaacacugaacaaucucuac

SEQ ID NO: 73462 - RNA, 27 nt, Artificial Sequence
  Nuclear receptor 2C2-associated protein (9-17)
gagaccgugagcagagucuccucuguu

SEQ ID NO: 73463 - RNA, 27 nt, Artificial Sequence
  Transitional endoplasmic reticulum ATPase (94-102)
gagaccguggucgaaguuccccaggug

SEQ ID NO: 73464 - RNA, 27 nt, Artificial Sequence
  Exportin-T (504-512)
gagaccguggucagauacgaaaaguuc

SEQ ID NO: 73465 - RNA, 27 nt, Artificial Sequence
  HLA class II histocompatibility antigen, DP alpha 1 chain (71-79)
gagaccguguggcaccuggaagaguuc

SEQ ID NO: 73466 - RNA, 36 nt, Artificial Sequence
  28S ribosomal protein S33, mitochondrial (47-58)
gagaccuacgacugguaucccaaccaccauacauac

SEQ ID NO: 73467 - RNA, 30 nt, Artificial Sequence
  Dedicator of cytokinesis protein 1 (40-49)
gagaccuacgaaggcugguauagaggguac

SEQ ID NO: 73468 - RNA, 27 nt, Artificial Sequence
  Pre-mRNA-processing factor 6 (444-452)
gagaccuacgaaaacgccagaaaggug

SEQ ID NO: 73469 - RNA, 27 nt, Artificial Sequence
  Transcription elongation factor SPT6 (938-946)
gagaccuacgaaugggccagaaagaug

SEQ ID NO: 73470 - RNA, 30 nt, Artificial Sequence
  Exocyst complex component 7 (575-584)
gagaccuacggcgccuuccugcagaaguuu

SEQ ID NO: 73471 - RNA, 27 nt, Artificial Sequence
  C-C motif chemokine 28 (119-127)
gagaccuacggccacaagacacccuau

SEQ ID NO: 73472 - RNA, 27 nt, Artificial Sequence
  Myotonin-protein kinase (311-319)
gagaccuacggcaagaucgugcacuau

SEQ ID NO: 73473 - RNA, 27 nt, Artificial Sequence
  Quinone oxidoreductase (51-59)
gagaccuacaucagaagcggcacauau

SEQ ID NO: 73474 - RNA, 30 nt, Artificial Sequence
  RNA-binding protein 8A (106-115)
gagaccuacaaggaagcccaggcugcaaug

SEQ ID NO: 73475 - RNA, 27 nt, Artificial Sequence
  Aurora kinase A (336-344)
gagaccuacaagagaaucagcagggug

SEQ ID NO: 73476 - RNA, 27 nt, Artificial Sequence
  60 kDa SS-A/Ro ribonucleoprotein (329-337)
gagaccuacaagacaggccacgggcug

SEQ ID NO: 73477 - RNA, 30 nt, Artificial Sequence; identical to SEQ ID NO: 49250
  U6 snRNA-associated Sm-like protein LSm4 (23-32)

SEQ ID NO: 73478 - RNA, 30 nt, Artificial Sequence; identical to SEQ ID NO: 49251
  Centromere protein J (230-239)

SEQ ID NO: 73479 - RNA, 30 nt, Artificial Sequence
  Arf-GAP with coiled-coil, ANK repeat and PH domain-containing protein 2 (748-757)
gagaccuaccaggacaucuucagagauuuu

SEQ ID NO: 73480 - RNA, 27 nt, Artificial Sequence
  Bifunctional coenzyme A synthase (290-298)
gagaccuacagaggcgggauggccauc

SEQ ID NO: 73481 - RNA, 36 nt, Artificial Sequence
  Vacuolar protein sorting-associated protein 13B (522-533)
gagaccuacacagaaaucgccggcaugcagagauuc

SEQ ID NO: 73482 - RNA, 27 nt, Artificial Sequence
  CD81 antigen (34-42)
gagguggccgcuggcaucuggggguuc

SEQ ID NO: 73483 - RNA, 36 nt, Artificial Sequence
  Transforming acidic coiled-coil-containing protein 3 (321-332)
gagguggccgcuggccagauggcaagcuccucuaga

SEQ ID NO: 73484 - RNA, 33 nt, Artificial Sequence
  Condensin complex subunit 2 (680-690)
gagguggccgacgaaaagaugcugagcggccuc

SEQ ID NO: 73485 - RNA, 30 nt, Artificial Sequence
  Rootletin (1797-1806)
gagguggccgaccuggaacuccagagaguc

SEQ ID NO: 73486 - RNA, 27 nt, Artificial Sequence
  KN motif and ankyrin repeat domain-containing protein 2 (488-496)
gagguggccgaccccaccgcucacaga

SEQ ID NO: 73487 - RNA, 27 nt, Artificial Sequence
  Protein phosphatase 1H (361-369)
gagguggccgaagcuaucacccaguuc

SEQ ID NO: 73488 - RNA, 27 nt, Artificial Sequence
  Geminin (143-151)
gagguggccgaacacguccaguacaug

SEQ ID NO: 73489 - RNA, 27 nt, Artificial Sequence
  Tankyrase-2 (672-680)
gagguggccgaacugcucgucaagcac

SEQ ID NO: 73490 - RNA, 30 nt, Artificial Sequence
  Abnormal spindle-like microcephaly-associated protein (73-82)
gagguggccgaagucaagaucagccacuuc

SEQ ID NO: 73491 - RNA, 27 nt, Artificial Sequence
  Tankyrase-1 (618-626)
gagguggccgaauaccugcucgagcac

SEQ ID NO: 73492 - RNA, 33 nt, Artificial Sequence
  HRAS-like suppressor 3 (72-82)
gagguggccggcgcuggggcagccagcgucaug

SEQ ID NO: 73493 - RNA, 27 nt, Artificial Sequence
  CAD protein (1287-1295)
gagguggccggcuucggggaaagcaga

SEQ ID NO: 73494 - RNA, 27 nt, Artificial Sequence
  5'-nucleotidase (100-108)
gagguggcccacuucaugaacgcucug

SEQ ID NO: 73495 - RNA, 33 nt, Artificial Sequence
  5'-nucleotidase (100-110)
gagguggcccacuucaugaacgcucugagauac

SEQ ID NO: 73496 - RNA, 27 nt, Artificial Sequence
  Protein disulfide-isomerase A4 (440-448)
gagguggccaaggacuuccccgaauac

SEQ ID NO: 73497 - RNA, 33 nt, Artificial Sequence
  Eukaryotic translation initiation factor 2-alpha kinase 1 (153-163)
gagguggcccuggaagcucagaccagcagauac

SEQ ID NO: 73498 - RNA, 27 nt, Artificial Sequence
  Amyloid protein-binding protein 2 (469-477)
gagguggcccugagcgucggccaccuc

SEQ ID NO: 73499 - RNA, 33 nt, Artificial Sequence
  Microtubule-associated protein 4 (341-351)
gagguggcccccgcuaaggacgucacccugcuc

SEQ ID NO: 73500 - RNA, 27 nt, Artificial Sequence
  Striatin (575-583)
gagguggcccccgcucugagcgucuuc

SEQ ID NO: 73501 - RNA, 33 nt, Artificial Sequence
  cDNA FLJ60317, highly similar to Aminoacylase-1 (EC 3.5.1.14) (143-153)
gagguggcccccggcuacgucguuaccgugcug

SEQ ID NO: 73502 - RNA, 27 nt, Artificial Sequence
  E3 ubiquitin-protein ligase TRIM63 (155-163)
gagguggccccccugcagagcgucuuc

SEQ ID NO: 73503 - RNA, 33 nt, Artificial Sequence
  Kelch-like protein 21 (364-374)
gagguggcccccaugcugaaggcuagagaauac

SEQ ID NO: 73504 - RNA, 30 nt, Artificial Sequence
  Endophilin-B2 (59-68)
gagguggcccccccugcuagcggcaccaga

SEQ ID NO: 73505 - RNA, 33 nt, Artificial Sequence
  Niemann-Pick C1 protein (730-740)
gagguggcccccagcauguuccuguccucuuuu

SEQ ID NO: 73506 - RNA, 27 nt, Artificial Sequence
  E3 ubiquitin-protein ligase Topors (578-586)
gagguggcccagcccagcagagaauuc

SEQ ID NO: 73507 - RNA, 33 nt, Artificial Sequence
  Zinc finger protein 131 (41-51)
gagguggccagcgcuaagcaguccgucaaauac

SEQ ID NO: 73508 - RNA, 27 nt, Artificial Sequence
  Autophagy-related protein 9A (160-168)
gagguggccagcgcucugagauccuuc

SEQ ID NO: 73509 - RNA, 27 nt, Artificial Sequence
  Methyltransferase-like protein 13 (163-171)
gagguggccacccagugguucggcuuu

SEQ ID NO: 73510 - RNA, 27 nt, Artificial Sequence
  D-3-phosphoglycerate dehydrogenase (159-167)
gagguggccaccagaaugcagagcuuc

SEQ ID NO: 73511 - RNA, 27 nt, Artificial Sequence
  DNA-dependent protein kinase catalytic subunit (713-721)
gagguggccgucaagaugaaacaguac

SEQ ID NO: 73512 - RNA, 33 nt, Artificial Sequence
  Ribonuclease H2 subunit C (72-82)
gagguggccguccccccuggccugguuggguac

SEQ ID NO: 73513 - RNA, 33 nt, Artificial Sequence
  Endoplasmic reticulum lectin 1 (124-134)
gaggugugccacggcaagcauaucagacaguac

SEQ ID NO: 73514 - RNA, 27 nt, Artificial Sequence
  Serine/threonine-protein phosphatase 4 regulatory subunit 2 (20-28)
gaggugugccccguccuggaccaguuc

SEQ ID NO: 73515 - RNA, 27 nt, Artificial Sequence
  FRAS1-related extracellular matrix protein 1 (1345-1353)
gagguggaccugaaccuccuuagauac

SEQ ID NO: 73516 - RNA, 33 nt, Artificial Sequence
  Melanoma-associated antigen 3 (168-178)
gagguggaccccaucggccaccuguacauuuuc

SEQ ID NO: 73517 - RNA, 27 nt, Artificial Sequence
  SET domain-containing protein 5 (26-34)
gagguggaagcccccuaccugagcaga

SEQ ID NO: 73518 - RNA, 30 nt, Artificial Sequence
  DENN domain-containing protein 5A (179-188)
gagguguucgccaacagauuuacccagaug

SEQ ID NO: 73519 - RNA, 30 nt, Artificial Sequence
  Nck-associated protein 1 (479-488)
gagguguucgacuuuagaggcaugaggcug

SEQ ID NO: 73520 - RNA, 30 nt, Artificial Sequence
  Probable ubiquitin carboxyl-terminal hydrolase FAF-X (1928-1937)
gagguguucgaccacaugaugaagagaaug

SEQ ID NO: 73521 - RNA, 30 nt, Artificial Sequence
  Disheveled-associated activator of morphogenesis 2 (1033-1042)
gagguguucgacaaggaucugugcaaacuc

SEQ ID NO: 73522 - RNA, 30 nt, Artificial Sequence
  Ribosomal RNA processing protein 36 homolog (132-141)
gagguguucgacaagaccuaccaguuucug

SEQ ID NO: 73523 - RNA, 36 nt, Artificial Sequence
  FAST kinase domain-containing protein 5 (107-118)
gagguguucgacagcuuugaaaacaugagagucuuc

SEQ ID NO: 73524 - RNA, 33 nt, Artificial Sequence
  Melanoma-associated antigen 2 (229-239)
gagguguucgaaggcagagaggacagcgucuuu

SEQ ID NO: 73525 - RNA, 30 nt, Artificial Sequence
  Protein arginine N-methyltransferase 5 (308-317)
gagguguucgaaaaggaccccaucaaauac

SEQ ID NO: 73526 - RNA, 30 nt, Artificial Sequence
  Presenilin-2 (337-346)
gagguguucgaacccccucugaccggcuac

SEQ ID NO: 73527 - RNA, 30 nt, Artificial Sequence
  GMP reductase 1 (254-263)
gagguguucgaaagaaacggcaggaagcug

SEQ ID NO: 73528 - RNA, 27 nt, Artificial Sequence
  Lanosterol synthase (479-487)
gagguguucggcgacaucaugauugau

SEQ ID NO: 73529 - RNA, 30 nt, Artificial Sequence
  Monocarboxylate transporter 7 (340-349)
gagguguucggcagaaucggggccggauuu

SEQ ID NO: 73530 - RNA, 27 nt, Artificial Sequence
  Zinc finger protein ZIC 2 (187-195)
gagguguucggcagaagcgaacaguac

SEQ ID NO: 73531 - RNA, 27 nt, Artificial Sequence
  Nesprin-2 (6334-6342)
gagguguucggcagagucagcagguuu

SEQ ID NO: 73532 - RNA, 27 nt, Artificial Sequence
  Trifunctional purine biosynthetic protein adenosine-3 (10-18)
gagguguuccacgccggcaccgcucug

SEQ ID NO: 73533 - RNA, 30 nt, Artificial Sequence
  Ribosomal protein S6 kinase alpha-5 (267-276)
gagguguuccacgaccagcugcauaccuuu

SEQ ID NO: 73534 - RNA, 30 nt, Artificial Sequence
  Non-POU domain-containing octamer-binding protein (13-22)
gagguguucauccacaaggacaaaggcuuu

SEQ ID NO: 73535 - RNA, 27 nt, Artificial Sequence
  DNA-directed RNA polymerase II subunit RPB4 (59-67)
gagguguucaugaagacccugaacuac

SEQ ID NO: 73536 - RNA, 30 nt, Artificial Sequence
  Quinone oxidoreductase (196-205)
gagguguucaaccacagagaagucaauuac

SEQ ID NO: 73537 - RNA, 30 nt, Artificial Sequence
  FACT complex subunit SPT16 (192-201)
gagguguucaacaaguuuuucaaagaaaga

SEQ ID NO: 73538 - RNA, 30 nt, Artificial Sequence
  UDP-N-acetylglucosamine-peptide N-acetylglucosaminyltransferase 110 kDa subunit (229-238)
gagguguuccccgaauuugccgcugcacac

SEQ ID NO: 73539 - RNA, 30 nt, Artificial Sequence
  Serine/threonine-protein kinase LATS2 (719-728)
gagguguuccccgaacaccuggccagauuu

SEQ ID NO: 73540 - RNA, 33 nt, Artificial Sequence
  Serine/threonine-protein phosphatase 6 regulatory ankyrin repeat subunit A (779-789)
gagguguuccagaagaccgaaggcaacgccuuu

SEQ ID NO: 73541 - RNA, 33 nt, Artificial Sequence
  Replication protein A 70 kDa DNA-binding subunit (560-570)
gagguguuccagaacgccaauuuuagaagcuuc

SEQ ID NO: 73542 - RNA, 30 nt, Artificial Sequence
  F-box/LRR-repeat protein 5 (115-124)
gagguguuccagcccaugcugauggaauac

SEQ ID NO: 73543 - RNA, 30 nt, Artificial Sequence
  Histone-lysine N-methyltransferase SETD2 (2472-2481)
gagguguucagaaaggaaaugagccaguuu

SEQ ID NO: 73544 - RNA, 30 nt, Artificial Sequence
  Zinc finger and SCAN domain-containing protein 30 (45-54)
gagguguucagacagaaguuuaggcaauuc

SEQ ID NO: 73545 - RNA, 30 nt, Artificial Sequence
  WD repeat and FYVE domain-containing protein 3 (667-676)
gagguguucagcggcgacgggagaaacuac

SEQ ID NO: 73546 - RNA, 30 nt, Artificial Sequence
  Coiled-coil domain-containing protein 136 (105-114)
gagguguucaccaagcagauccaacagcug

SEQ ID NO: 73547 - RNA, 30 nt, Artificial Sequence; identical to SEQ ID NO: 49320
  RCC1 and BTB domain-containing protein 2 (124-133)

SEQ ID NO: 73548 - RNA, 33 nt, Artificial Sequence
  Pre-mRNA-splicing factor ATP-dependent RNA helicase DHX15 (379-389)
gaggugggcgacaucaagauuauaccccuguac

SEQ ID NO: 73549 - RNA, 27 nt, Artificial Sequence
  Protein AAR2 homolog (40-48)
gaggugggccccaaguucagagggguc

SEQ ID NO: 73550 - RNA, 30 nt, Artificial Sequence
  Adipocyte plasma membrane-associated protein (403-412)
gaggugcacgaacaugacggccaccuguac

SEQ ID NO: 73551 - RNA, 33 nt, Artificial Sequence
  Adipocyte plasma membrane-associated protein (403-413)
gaggugcacgaacaugacggccaccuguaccuc

SEQ ID NO: 73552 - RNA, 36 nt, Artificial Sequence
  Phosphatase and actin regulator 1 (636-647)
gaggugcacgaacugagcagacaucucaccagguuc

SEQ ID NO: 73553 - RNA, 30 nt, Artificial Sequence
  GPI transamidase component PIG-T (291-300)
gaggugcaccccccuccaaccacaacuuac

SEQ ID NO: 73554 - RNA, 33 nt, Artificial Sequence
  Aryl hydrocarbon receptor nuclear translocator 2 (438-448)
gaggugcaccagagagacggccugagcuccuac

SEQ ID NO: 73555 - RNA, 30 nt, Artificial Sequence
  Uncharacterized protein C1orf131 (173-182)
gaggugcacagauucggcaucaccggguac

SEQ ID NO: 73556 - RNA, 36 nt, Artificial Sequence
  2-methoxy-6-polyprenyl-1,4-benzoquinol methylase, mitochondrial (272-283)
gaggugaucgccggcgacuggaagagcuaccaguau

SEQ ID NO: 73557 - RNA, 27 nt, Artificial Sequence
  DNA mismatch repair protein Msh2 (914-922)
gaggugaucgccaagaacaauagcuuc

SEQ ID NO: 73558 - RNA, 36 nt, Artificial Sequence
  Protein CutA (104-115)
gaggugaucgcccugcccgucgaacagggcaacuuc

SEQ ID NO: 73559 - RNA, 33 nt, Artificial Sequence
  Drebrin-like protein (403-413)
gaggugaucgacgaaggcugguggagaggguac

SEQ ID NO: 73560 - RNA, 33 nt, Artificial Sequence; identical to SEQ ID NO: 49333
  Alpha/beta hydrolase domain-containing protein 17B (236-246)

SEQ ID NO: 73561 - RNA, 36 nt, Artificial Sequence; identical to SEQ ID NO: 49334
  Alpha/beta hydrolase domain-containing protein 17A (256-267)

SEQ ID NO: 73562 - RNA, 33 nt, Artificial Sequence; identical to SEQ ID NO: 49335
  Alpha/beta hydrolase domain-containing protein 17C (277-287)

SEQ ID NO: 73563 - RNA, 36 nt, Artificial Sequence; identical to SEQ ID NO: 49336
  Alpha/beta hydrolase domain-containing protein 17C (277-288)

SEQ ID NO: 73564 - RNA, 36 nt, Artificial Sequence; identical to SEQ ID NO: 49337
  SH3 and PX domain-containing protein 2A (332-343)

SEQ ID NO: 73565 - RNA, 27 nt, Artificial Sequence
  XK-related protein 9 (123-131)
gaggugaucgacagagucaccgaucug

SEQ ID NO: 73566 - RNA, 30 nt, Artificial Sequence
  Histidine-tRNA ligase, cytoplasmic (90-99)
gaggugaucgacacccccgucuucgaacug

SEQ ID NO: 73567 - RNA, 27 nt, Artificial Sequence
  SNF-related serine/threonine-protein kinase (80-88)
gaggugaucgacacccagacaaagcug

SEQ ID NO: 73568 - RNA, 27 nt, Artificial Sequence
  Mitochondrial ribonuclease P protein 3 (193-201)
gaggugaucgacgucuucgaaauuaug

SEQ ID NO: 73569 - RNA, 33 nt, Artificial Sequence
  Mitochondrial ribonuclease P protein 3 (193-203)
gaggugaucgacgucuucgaaauuaugaaggcc

SEQ ID NO: 73570 - RNA, 30 nt, Artificial Sequence
  N-terminal Xaa-Pro-Lys N-methyltransferase 1 (4-13)
gaggugaucgaagacgagaagcaguucuac

SEQ ID NO: 73571 - RNA, 27 nt, Artificial Sequence
  T-complex protein 1 subunit theta (127-135)
gaggugaucgaaggcuacgagauugcc

SEQ ID NO: 73572 - RNA, 30 nt, Artificial Sequence
  Phosphatidate phosphatase LPIN1 (766-775)
gaggugaucgaaaagaaacccgagaaguuc

SEQ ID NO: 73573 - RNA, 30 nt, Artificial Sequence
  SH3 and PX domain-containing protein 2B (396-405)
gaggugaucgaaaagaaccugagcggcugg

SEQ ID NO: 73574 - RNA, 30 nt, Artificial Sequence
  Dynamin-1-like protein (634-643)
gaggugaucgaaagacugauuaagagcuac

SEQ ID NO: 73575 - RNA, 27 nt, Artificial Sequence
  Asparagine synthetase (glutamine-hydrolyzing) (326-334)
gaggugaucuucagccuggaaaccuac

SEQ ID NO: 73576 - RNA, 30 nt, Artificial Sequence
  Dynamin-like 120 kDa protein, mitochondrial (156-165)
gaggugaucggcgccagcgaccugcuccuu

SEQ ID NO: 73577 - RNA, 33 nt, Artificial Sequence
  Dynamin-like 120 kDa protein, mitochondrial (156-166)
gaggugaucggcgccagcgaccugcuccuucug

SEQ ID NO: 73578 - RNA, 27 nt, Artificial Sequence
  Protein phosphatase 1 regulatory subunit 37 (75-83)
gaggugaucggcgccuacaagcaggcu

SEQ ID NO: 73579 - RNA, 33 nt, Artificial Sequence; identical to SEQ ID NO: 49352
  Protein TMEPAI (199-209)

SEQ ID NO: 73580 - RNA, 36 nt, Artificial Sequence
  Mitogen-activated protein kinase kinase kinase 11 (121-132)
gaggugaucggcauugggggauucgguaaggucuac

SEQ ID NO: 73581 - RNA, 33 nt, Artificial Sequence
  Ropporin-1B (190-200)
gaggugaucggccccgacgggcugauuaccguc

SEQ ID NO: 73582 - RNA, 36 nt, Artificial Sequence
  Hepatocyte growth factor receptor (215-226)
gaggugaucggcagagggcacuucggaugcgucuac

SEQ ID NO: 73583 - RNA, 33 nt, Artificial Sequence
  Inositol-trisphosphate 3-kinase B (875-885)
gaggugaucggcagcucccugcucuucauucac

SEQ ID NO: 73584 - RNA, 33 nt, Artificial Sequence; identical to SEQ ID NO: 49357
  Protein furry homolog-like (141-151)

SEQ ID NO: 73585 - RNA, 30 nt, Artificial Sequence
  Transportin-3 (359-368)
gaggugauccacggcauuuucaaggccuac

SEQ ID NO: 73586 - RNA, 27 nt, Artificial Sequence
  ELAV-like protein 1 (101-109)
gaggugaucaaggacgccaaccuguac

SEQ ID NO: 73587 - RNA, 36 nt, Artificial Sequence
  Exocyst complex component 3 (390-401)
gaggugaucaagcugaccgaccccagccuccuuuac

SEQ ID NO: 73588 - RNA, 30 nt, Artificial Sequence
  Eukaryotic translation initiation factor 3 subunit L (50-59)
gaggugaucaagaacuucauucaguacuuu

SEQ ID NO: 73589 - RNA, 30 nt, Artificial Sequence
  Ribosome maturation protein SBDS (156-165)
gaggugaucaagcagcugaaagaaaagaug

SEQ ID NO: 73590 - RNA, 27 nt, Artificial Sequence
  Myosin-10 (1642-1650)
gaggugaucaagcagcugagaaaacuc

SEQ ID NO: 73591 - RNA, 27 nt, Artificial Sequence
  Exosome complex component RRP43 (268-276)
gaggugaucaagagcaugaaacccaag

SEQ ID NO: 73592 - RNA, 27 nt, Artificial Sequence
  Cofilin-2 (10-18)
gaggugaucaaggucuucaacgacaug

SEQ ID NO: 73593 - RNA, 27 nt, Artificial Sequence
  T-complex protein 1 subunit beta (512-520)
gaggugauccugagagucgacaacauu

SEQ ID NO: 73594 - RNA, 30 nt, Artificial Sequence
  E3 ubiquitin-protein ligase TRIM63 (81-90)
gaggugaucauggacagacacggcgucuac

SEQ ID NO: 73595 - RNA, 33 nt, Artificial Sequence
  Nucleosome-remodeling factor subunit BPTF (564-574)
gaggugaucaugaagggcaacauuaauaacuac

SEQ ID NO: 73596 - RNA, 27 nt, Artificial Sequence
  Gamma-interferon-inducible protein 16 (15-23)
gaggugaucaacgacuaccacuucaga

SEQ ID NO: 73597 - RNA, 33 nt, Artificial Sequence
  Rho guanine nucleotide exchange factor 12 (790-800)
gaggugaucaacgaacuguucuacaccgagaga

SEQ ID NO: 73598 - RNA, 30 nt, Artificial Sequence
  Eukaryotic translation initiation factor 3 subunit G (58-67)
gaggugaucaacggcaauauuaagaccguc

SEQ ID NO: 73599 - RNA, 27 nt, Artificial Sequence
  Isoleucine-tRNA ligase, cytoplasmic (989-997)
gaggugaucaacagaauucagaagcug

SEQ ID NO: 73600 - RNA, 27 nt, Artificial Sequence
  Trafficking protein particle complex subunit 9 (680-688)
gaggugauccccgcccugccuagacuc

SEQ ID NO: 73601 - RNA, 30 nt, Artificial Sequence
  Dynactin subunit 6 (135-144)
gaggugauccccgaaaacaccgucauuuac

SEQ ID NO: 73602 - RNA, 27 nt, Artificial Sequence
  Transcriptional adapter 1 (289-297)
gaggugauccccacccacacagucuac

SEQ ID NO: 73603 - RNA, 33 nt, Artificial Sequence
  Heme oxygenase 1 (103-113)
gaggugauccccuacaccccugccaugcagaga

SEQ ID NO: 73604 - RNA, 36 nt, Artificial Sequence
  Heme oxygenase 1 (103-114)
gaggugauccccuacaccccugccaugcagagauau

SEQ ID NO: 73605 - RNA, 39 nt, Artificial Sequence; identical to SEQ ID NO: 49378
  MAX gene-associated protein (214-226)

SEQ ID NO: 73606 - RNA, 36 nt, Artificial Sequence
  Kalirin (827-838)
gaggugauccagcaaggccaggaccugcaccaguac

SEQ ID NO: 73607 - RNA, 27 nt, Artificial Sequence
  Cyclin-I (47-55)
gaggugauccaguggcuggccaagcuc

SEQ ID NO: 73608 - RNA, 27 nt, Artificial Sequence
  Protein dopey-2 (236-244)
gaggugaucagagccuucuacagcuau

SEQ ID NO: 73609 - RNA, 27 nt, Artificial Sequence
  Inositol-tetrakisphosphate 1-kinase (260-268)
gaggugaucagagaacugagcagggcc

SEQ ID NO: 73610 - RNA, 30 nt, Artificial Sequence
  Serine/threonine-protein kinase ICK (67-76)
gaggugaucagagaaaacgaccaccuguac

SEQ ID NO: 73611 - RNA, 39 nt, Artificial Sequence
  Peptidyl-prolyl cis-trans isomerase FKBP1A (55-67)
gaggugaucagaggcugggaagagggggucgcccagaug

SEQ ID NO: 73612 - RNA, 27 nt, Artificial Sequence
  BCL2/adenovirus E1B 19 kDa protein-interacting protein 2 (170-178)
gaggugaucagaaagggcagcauuacc

SEQ ID NO: 73613 - RNA, 33 nt, Artificial Sequence
  BCL2/adenovirus E1B 19 kDa protein-interacting protein 2 (170-180)
gaggugaucagaaagggcagcauuaccgaauac

SEQ ID NO: 73614 - RNA, 33 nt, Artificial Sequence
  General vesicular transport factor p115 (180-190)
gaggugaucagaaacgacggcguccugcuccuu

SEQ ID NO: 73615 - RNA, 36 nt, Artificial Sequence
  Mitogen-activated protein kinase kinase kinase 3 (568-579)
gaggugaucagcggcgaaggguacggaagaaaggcc

SEQ ID NO: 73616 - RNA, 30 nt, Artificial Sequence
  Protein FRA10AC1 (165-174)
gaggugaucagcggcaaggggcaguucuuu

SEQ ID NO: 73617 - RNA, 30 nt, Artificial Sequence
  Ectonucleoside triphosphate diphosphohydrolase 4 (216-225)
gaggugaucagcggcaagcaggaagggguc

SEQ ID NO: 73618 - RNA, 33 nt, Artificial Sequence
  Ectonucleoside triphosphate diphosphohydrolase 4 (216-226)
gaggugaucagcggcaagcaggaaggggucuac

SEQ ID NO: 73619 - RNA, 36 nt, Artificial Sequence
  Protein CIP2A (34-45)
gaggugaucagcggccagaagcugaccagacucuuc

SEQ ID NO: 73620 - RNA, 27 nt, Artificial Sequence
  Syntaxin-18 (55-63)
gaggugaucagccacauuggcaagcug

SEQ ID NO: 73621 - RNA, 27 nt, Artificial Sequence
  CREB3 regulatory factor (131-139)
gaggugaucagcaagacccccacacug

SEQ ID NO: 73622 - RNA, 27 nt, Artificial Sequence
  Cullin-9 (584-592)
gaggugaucagcaaguacgaaaaagcc

SEQ ID NO: 73623 - RNA, 27 nt, Artificial Sequence
  FAS-associated factor 2 (195-203)
gaggugaucagccugauuaacaccaga

SEQ ID NO: 73624 - RNA, 30 nt, Artificial Sequence
  Pseudopodium-enriched atypical kinase 1 (20-29)
gaggugaucagcaacgaaggcgggagauuc

SEQ ID NO: 73625 - RNA, 30 nt, Artificial Sequence
  Alpha-1,3-mannosyl-glycoprotein 4-beta-N-acetylglucosaminyltransferase B (111-120)
gaggugaucagccccuccccucacuucuac

SEQ ID NO: 73626 - RNA, 27 nt, Artificial Sequence
  ATP-binding cassette sub-family A member 5 (1411-1419)
gaggugaucagcagaauuacccacgcc

SEQ ID NO: 73627 - RNA, 36 nt, Artificial Sequence
  Importin subunit alpha-5 (120-131)
gaggugaucagcacccccggcgucguugccagauuc

SEQ ID NO: 73628 - RNA, 27 nt, Artificial Sequence
  Ankycorbin (933-941)
gaggugaucagcgucuacagaaugcac

SEQ ID NO: 73629 - RNA, 27 nt, Artificial Sequence
  Ataxin-2 (291-299)
gaggugaucagcuggggcuccgggaga

SEQ ID NO: 73630 - RNA, 33 nt, Artificial Sequence; identical to SEQ ID NO: 49403
  Unconventional myosin-X (308-318)

SEQ ID NO: 73631 - RNA, 33 nt, Artificial Sequence
  Ras GTPase-activating protein 3 (134-144)
gaggugaucaccgacacaggcgucguuugccac

SEQ ID NO: 73632 - RNA, 30 nt, Artificial Sequence
  Nuclear export mediator factor NEMF (306-315)
gaggugaucacccacgaacugcaggacuuc

SEQ ID NO: 73633 - RNA, 33 nt, Artificial Sequence
  Phospholipid scramblase 2 (86-96)
gaggugaucacccuggaaagaccccucaggugc

SEQ ID NO: 73634 - RNA, 30 nt, Artificial Sequence
  A-kinase anchor protein 9 (1601-1610)
gaggugaucaccaacagacccaagggcuuc

SEQ ID NO: 73635 - RNA, 36 nt, Artificial Sequence
  Translation initiation factor eIF-2B subunit gamma (272-283)
gaggugaucgucggcaacgaccagcugauggaaauu

SEQ ID NO: 73636 - RNA, 27 nt, Artificial Sequence
  Methylmalonyl-CoA mutase, mitochondrial (484-492)
gaggugaucgucggcguuaacaaguac

SEQ ID NO: 73637 - RNA, 27 nt, Artificial Sequence
  Insulin-like growth factor 2 mRNA-binding protein 2 (555-563)
gaggugaucgucagaauuauaggccac

SEQ ID NO: 73638 - RNA, 27 nt, Artificial Sequence
  Dynactin subunit 4 (424-432)
gaggugaucuggcugacccagcacguc

SEQ ID NO: 73639 - RNA, 33 nt, Artificial Sequence
  Actin-related protein 8 (209-219)
gaggugaucuggagccacgccauucagaaguac

SEQ ID NO: 73640 - RNA, 27 nt, Artificial Sequence
  BTB/POZ domain-containing protein 10 (398-406)
gaggugaucuacaacuauguccagaga

SEQ ID NO: 73641 - RNA, 27 nt, Artificial Sequence
  Ras GTPase-activating-like protein IQGAP1 (1602-1610)
gaggugaaggccaaauucaugggcguc

SEQ ID NO: 73642 - RNA, 27 nt, Artificial Sequence
  E3 ubiquitin-protein ligase CBL-B (290-298)
gaggugaaggccagacugcagaaauac

SEQ ID NO: 73643 - RNA, 33 nt, Artificial Sequence
  F-box only protein 22 (380-390)
gaggugaaggacgaugaccuguuccacagcuac

SEQ ID NO: 73644 - RNA, 33 nt, Artificial Sequence
  Cation-independent mannose-6-phosphate receptor (1228-1238)
gaggugaaggaccccagacacggcaaccuguac

SEQ ID NO: 73645 - RNA, 30 nt, Artificial Sequence
  Centromere protein F (1197-1206)
gaggugaaggaaaucagccuggacuccuac

SEQ ID NO: 73646 - RNA, 27 nt, Artificial Sequence
  Apolipoprotein E (249-257)
gaggugaaggaacaggucgccgagguu

SEQ ID NO: 73647 - RNA, 27 nt, Artificial Sequence
  Ras association domain-containing protein 8 (290-298)
gaggugaagggcaaaaucgggaagguc

SEQ ID NO: 73648 - RNA, 30 nt, Artificial Sequence
  Prolyl endopeptidase-like (114-123)
gaggugaagcacggcggguucgucuacuau

SEQ ID NO: 73649 - RNA, 27 nt, Artificial Sequence
  Ras association domain-containing protein 2 (297-305)
gaggugaagaaacugaugagaaaguac

SEQ ID NO: 73650 - RNA, 27 nt, Artificial Sequence
  Ethylmalonyl-CoA decarboxylase (36-44)
gaggugaagaaaacccugcagcaauuc

SEQ ID NO: 73651 - RNA, 27 nt, Artificial Sequence
  Proteasome activator complex subunit 3 (10-18)
gaggugaagcugaaagucgacagcuuc

SEQ ID NO: 73652 - RNA, 27 nt, Artificial Sequence
  Integrator complex subunit 11 (350-358)
gaggugaagaugcaggucgaauacaug

SEQ ID NO: 73653 - RNA, 27 nt, Artificial Sequence
  Elongator complex protein 1 (50-58)
gaggugaagaacgaagucagccugguu

SEQ ID NO: 73654 - RNA, 45 nt, Artificial Sequence
  Delta-1-pyrroline-5-carboxylate synthase (320-334)
gaggugaagcccgccggcccuaccgucgaacagcaaggggagaug

SEQ ID NO: 73655 - RNA, 48 nt, Artificial Sequence
  Delta-1-pyrroline-5-carboxylate synthase (320-335)
gaggugaagcccgccggcccuaccgucgaacagcaaggggagauggcu

SEQ ID NO: 73656 - RNA, 27 nt, Artificial Sequence
  Ras-related GTP-binding protein D (60-68)
gaggugaagcccagaauccugcucaug

SEQ ID NO: 73657 - RNA, 27 nt, Artificial Sequence
  Histone deacetylase 9 (142-150)
gaggugaagcagaaacugcaagaauuc

SEQ ID NO: 73658 - RNA, 27 nt, Artificial Sequence
  Periodic tryptophan protein 1 homolog (31-39)
gaggugaagagacugaucgccgaagcu

SEQ ID NO: 73659 - RNA, 27 nt, Artificial Sequence
  Pachytene checkpoint protein 2 homolog (146-154)
gaggugaagagccaccugcucgacuac

SEQ ID NO: 73660 - RNA, 27 nt, Artificial Sequence
  Apoptosis-inducing factor 1, mitochondrial (276-284)
gaggugaagagcagaaccacacuguuc

SEQ ID NO: 73661 - RNA, 27 nt, Artificial Sequence
  Chloride intracellular channel protein 4 (83-91)
gaggugaagaccgacgucaacaaaauc

SEQ ID NO: 73662 - RNA, 27 nt, Artificial Sequence
  Kinetochore-associated protein DSN1 homolog (235-243)
gaggugaaggucgaacccaugaccuac

SEQ ID NO: 73663 - RNA, 27 nt, Artificial Sequence
  Glycerol-3-phosphate dehydrogenase, mitochondrial (410-418)
gaggugaaguacggcaucaaagaauau

SEQ ID NO: 73664 - RNA, 27 nt, Artificial Sequence
  Bifunctional coenzyme A synthase (63-71)
gaggugcuggacuucaucacccaccuc

SEQ ID NO: 73665 - RNA, 30 nt, Artificial Sequence
  Insulin-like growth factor 2 mRNA-binding protein 2 (95-104)
gaggugcuggacggccuccuugcccaguac

SEQ ID NO: 73666 - RNA, 30 nt, Artificial Sequence
  Serine/threonine-protein kinase PRP4 homolog (170-179)
gaggugcuggacaagagauacaacgucuau

SEQ ID NO: 73667 - RNA, 33 nt, Artificial Sequence
  Estradiol 17-beta-dehydrogenase 1 (203-213)
gaggugcuggacagaaccgauauccacacauuc

SEQ ID NO: 73668 - RNA, 30 nt, Artificial Sequence
  Receptor-type protein tyrosine phosphatase beta (1332-1341)
gaggugcuggacagccacauccaugccuac

SEQ ID NO: 73669 - RNA, 30 nt, Artificial Sequence
  Insulin-like growth factor 2 mRNA-binding protein 3 (95-104)
gaggugcuggacagccuccuuguccaguac

SEQ ID NO: 73670 - RNA, 27 nt, Artificial Sequence
  StAR-related lipid transfer protein 7, mitochondrial (136-144)
gaggugcugcacugggucacccauuuc

SEQ ID NO: 73671 - RNA, 30 nt, Artificial Sequence; identical to SEQ ID NO: 49444
  Ubiquitin-associated protein 1-like (34-43)

SEQ ID NO: 73672 - RNA, 30 nt, Artificial Sequence
  Mitofusin-2 (308-317)
gaggugcugaacgccagaauccagaaggcu

SEQ ID NO: 73673 - RNA, 30 nt, Artificial Sequence
  Exportin-6 (272-281)
gaggugcugaacagaauccaguucagguac

SEQ ID NO: 73674 - RNA, 30 nt, Artificial Sequence
  Ancient ubiquitous protein 1 (306-315)
gaggugcugccccacgucccucucggcguu

SEQ ID NO: 73675 - RNA, 30 nt, Artificial Sequence
  Spectrin alpha chain, non-erythrocytic 1 (185-194)
gaggugcugcagaagaaauucgaagaguuu

SEQ ID NO: 73676 - RNA, 27 nt, Artificial Sequence
  Importin-7 (378-386)
gaggugcugcagaagaccaugggcuuc

SEQ ID NO: 73677 - RNA, 27 nt, Artificial Sequence
  Class E basic helix-loop-helix protein 41 (141-149)
gaggugcugcaguaccucagcagauuc

SEQ ID NO: 73678 - RNA, 27 nt, Artificial Sequence
  MAGEC3 protein (192-200)
gaggugcugagcgccaucggcgucugc

SEQ ID NO: 73679 - RNA, 33 nt, Artificial Sequence
  Serine/threonine-protein kinase Nek2 (9-19)
gaggugcuguacaccaucggcacagggagcuau

SEQ ID NO: 73680 - RNA, 33 nt, Artificial Sequence
  Ly6/PLAUR domain-containing protein 1 isoform c (73-83)
gaggugauggaacagagcgccggcaucauguac

SEQ ID NO: 73681 - RNA, 30 nt, Artificial Sequence
  Protein FAM118A (215-224)
gaggugauggaaguccugcagaaccucuac

SEQ ID NO: 73682 - RNA, 36 nt, Artificial Sequence
  Proteasome maturation protein (125-136)
gaggugaugggcgaaccccaccugauggucgaguac

SEQ ID NO: 73683 - RNA, 30 nt, Artificial Sequence
  Isoprenoid synthase domain-containing protein isoform X7 (103-112)
gaggugaugaagagcaucauucagaaauac

SEQ ID NO: 73684 - RNA, 30 nt, Artificial Sequence; identical to SEQ ID NO: 49457
  Alkyldihydroxyacetonephosphate synthase, peroxisomal (89-98)

SEQ ID NO: 73685 - RNA, 33 nt, Artificial Sequence
  Protein-L-isoaspartate(D-aspartate) O-methyltransferase (30-40)
gaggugaugcuggccaccgacagaagccacuac

SEQ ID NO: 73686 - RNA, 30 nt, Artificial Sequence
  Prolyl 3-hydroxylase 1 (335-344)
gaggugaugaaccagaaucuggccuacuau

SEQ ID NO: 73687 - RNA, 27 nt, Artificial Sequence
  tRNA-dihydrouridine(20) synthase (NAD(P)+)-like (227-235)
gaggugaugcagaaguacaucagauau

SEQ ID NO: 73688 - RNA, 30 nt, Artificial Sequence
  Actin-related protein 2/3 complex subunit 3 (127-136)
gaggugaugagagccuaccugcagcaacuc

SEQ ID NO: 73689 - RNA, 27 nt, Artificial Sequence
  Transcription factor SOX-10 (284-292)
gaggugaugagcaacauggaaaccuuc

SEQ ID NO: 73690 - RNA, 30 nt, Artificial Sequence; identical to SEQ ID NO: 49463
  Mitofusin-2 (23-32)

SEQ ID NO: 73691 - RNA, 33 nt, Artificial Sequence
  Procollagen C-endopeptidase enhancer 2 (220-230)
gaggugaacgacgccagaaggaucggcaaguac

SEQ ID NO: 73692 - RNA, 27 nt, Artificial Sequence
  Ankycorbin (840-848)
gaggugaacgaacugcuccagaaguuc

SEQ ID NO: 73693 - RNA, 27 nt, Artificial Sequence
  mRNA turnover protein 4 homolog (111-119)
gaggugaacgaaugguucaccaaguac

SEQ ID NO: 73694 - RNA, 30 nt, Artificial Sequence
  Ethanolamine-phosphate cytidylyltransferase (254-263)
gaggugaaccacuacaagggcaaaaauuau

SEQ ID NO: 73695 - RNA, 27 nt, Artificial Sequence
  Long-chain-fatty-acid-CoA ligase 4 (89-97)
gaggugaacagaagggucaauaacuuc

SEQ ID NO: 73696 - RNA, 27 nt, Artificial Sequence
  Serpin B8 (76-84)
gaggugaacagaaccggcacacaguac

SEQ ID NO: 73697 - RNA, 27 nt, Artificial Sequence
  T-complex protein 1 subunit zeta (101-109)
gaggugaacagcggcuucuuuuacaag

SEQ ID NO: 73698 - RNA, 27 nt, Artificial Sequence
  Sodium/potassium/calcium exchanger 5 (372-380)
gaggugaacagcagaggccugaccuac

SEQ ID NO: 73699 - RNA, 30 nt, Artificial Sequence
  Putative PIP5K1A and PSMD4-like protein (632-641)
gaggugaacaccgaaaagcugacagccuuc

SEQ ID NO: 73700 - RNA, 33 nt, Artificial Sequence
  FAST kinase domain-containing protein 1 (204-214)
gaggugaacgucgccaagagcaucgcuaaauuc

SEQ ID NO: 73701 - RNA, 27 nt, Artificial Sequence
  Protein NATD1 (59-67)
gaggugcccgacgccuacagaggcagg

SEQ ID NO: 73702 - RNA, 27 nt, Artificial Sequence
  Thioredoxin-like protein 4A (65-73)
gaggugcccgacuucaacaagauguac

SEQ ID NO: 73703 - RNA, 36 nt, Artificial Sequence
  Cyclin-A2 (174-185)
gaggugcccgacuaccacgaagauauccauaccuau

SEQ ID NO: 73704 - RNA, 30 nt, Artificial Sequence
  Protein FAM135B (80-89)
gaggugcccaucaacgacgccgucguuuuc

SEQ ID NO: 73705 - RNA, 27 nt, Artificial Sequence
  Serine/threonine-protein kinase 36 (1232-1240)
gaggugccccagagacugcucgaaaug

SEQ ID NO: 73706 - RNA, 30 nt, Artificial Sequence
  La-related protein 1 (262-271)
gaggugcccagagaaaagcuggccagcagg

SEQ ID NO: 73707 - RNA, 30 nt, Artificial Sequence
  Meckel syndrome type 1 protein (150-159)
gaggugcccagcuuccuggucgaaagaaug

SEQ ID NO: 73708 - RNA, 30 nt, Artificial Sequence; identical to SEQ ID NO: 49481
  Copine-1 (173-182)

SEQ ID NO: 73709 - RNA, 39 nt, Artificial Sequence
  Macrophage-capping protein (97-109)
gaggugcagggcaacgaaagcgaccuguucauguccuac

SEQ ID NO: 73710 - RNA, 27 nt, Artificial Sequence
  26S protease regulatory subunit 8 (142-150)
gaggugcagagaaccaugcuggaacuc

SEQ ID NO: 73711 - RNA, 27 nt, Artificial Sequence
  Coatomer subunit gamma-2 (523-531)
gaggugagagacagggccaccuucuac

SEQ ID NO: 73712 - RNA, 30 nt, Artificial Sequence
  Ubiquitin-protein ligase E3C (567-576)
gaggugagagaagaguacaucaccgccuuc

SEQ ID NO: 73713 - RNA, 30 nt, Artificial Sequence
  Lactadherin (36-45)
gaggugagaggcgacgucuuccccagcuac

SEQ ID NO: 73714 - RNA, 27 nt, Artificial Sequence
  Spindle and kinetochore-associated protein 1 (243-251)
gaggugagaggcgggggacugaccagg

SEQ ID NO: 73715 - RNA, 30 nt, Artificial Sequence
  Spindle and kinetochore-associated protein 1 (243-252)
gaggugagaggcgggggacugaccagguac

SEQ ID NO: 73716 - RNA, 30 nt, Artificial Sequence
  GTP-binding protein 1 (445-454)
gaggugagaggcgggcagaccgccagcuuc

SEQ ID NO: 73717 - RNA, 27 nt, Artificial Sequence
  Glutaredoxin-3 (140-148)
gaggugagacagggccugaaggccuac

SEQ ID NO: 73718 - RNA, 30 nt, Artificial Sequence
  Fatty acid synthase (674-683)
gaggugagaaccggcgggauggccuuccac

SEQ ID NO: 73719 - RNA, 27 nt, Artificial Sequence
  Putative butyrophilin subfamily 2 member A3 (62-70)
gaggugagaugguuccagagccaauuu

SEQ ID NO: 73720 - RNA, 27 nt, Artificial Sequence
  Butyrophilin subfamily 2 member A1 (63-71)
gaggugagaugguucaggagccaguuu

SEQ ID NO: 73721 - RNA, 30 nt, Artificial Sequence
  Interleukin-1 receptor-associated kinase 4 (159-168)
gaggugagcgacaccagauuccacuccuuu

SEQ ID NO: 73722 - RNA, 27 nt, Artificial Sequence
  E3 ubiquitin-protein ligase UBR5 (24-32)
gaggugagcgaaaagcugaacaaauac

SEQ ID NO: 73723 - RNA, 27 nt, Artificial Sequence
  Protein FAM111B (228-236)
gaggugagcggcaagguccuggaaaug

SEQ ID NO: 73724 - RNA, 33 nt, Artificial Sequence
  Cytosolic carboxypeptidase 1 (764-774)
gaggugagcggcaugagacccggggucgccuac

SEQ ID NO: 73725 - RNA, 27 nt, Artificial Sequence
  Alpha-actinin-1 (574-582)
gaggugagcaagaucguccagaccuac

SEQ ID NO: 73726 - RNA, 27 nt, Artificial Sequence
  cGMP-inhibited 3',5'-cyclic phosphodiesterase B (656-664)
gaggugagccuggaccucauccuuguc

SEQ ID NO: 73727 - RNA, 33 nt, Artificial Sequence
  Growth hormone-inducible transmembrane protein (303-313)
gaggugagccccauguacggcguccagaaguau

SEQ ID NO: 73728 - RNA, 27 nt, Artificial Sequence
  NADH-ubiquinone oxidoreductase 75 kDa subunit, mitochondrial (537-545)
gaggugagccccaaccuggucagauac

SEQ ID NO: 73729 - RNA, 30 nt, Artificial Sequence
  Proton myo-inositol cotransporter (179-188)
gaggugagccccccuaaccugagaggcagg

SEQ ID NO: 73730 - RNA, 27 nt, Artificial Sequence
  Abnormal spindle-like microcephaly-associated protein (322-330)
gaggugagccccagaaucccugaaugc

SEQ ID NO: 73731 - RNA, 30 nt, Artificial Sequence
  AP-1 complex subunit beta-1 (934-943)
gaggugagccagcacgucuaccaagccuau

SEQ ID NO: 73732 - RNA, 27 nt, Artificial Sequence
  Transcription factor TFIIIB component B'' homolog (1376-1384)
gaggugagcucccacuucucucauuuu

SEQ ID NO: 73733 - RNA, 30 nt, Artificial Sequence
  Retinoblastoma-like protein 1 (130-139)
gaggugagcaccgucaucuucaagaaauac

SEQ ID NO: 73734 - RNA, 33 nt, Artificial Sequence
  Xenotropic and polytropic retrovirus receptor 1 (40-50)
gaggugaccgacgaagauacagucaagagauac

SEQ ID NO: 73735 - RNA, 30 nt, Artificial Sequence
  U3 small nucleolar ribonucleoprotein protein IMP3 (22-31)
gaggugaccgaccacaaccugcaugaacuc

SEQ ID NO: 73736 - RNA, 27 nt, Artificial Sequence
  Ankyrin repeat domain-containing protein 54 (279-287)
gaggugaccgaccugcucgccagcuuc

SEQ ID NO: 73737 - RNA, 36 nt, Artificial Sequence
  Protein SET (111-122)
gaggugaccgaauucgaggacaucaagagcggcuac

SEQ ID NO: 73738 - RNA, 27 nt, Artificial Sequence
  Prostaglandin E synthase 2 (201-209)
gaggugaccgaauucggcaacaaguac

SEQ ID NO: 73739 - RNA, 27 nt, Artificial Sequence
  Zinc finger CCHC domain-containing protein 14 (136-144)
gaggugaccgaauucaucagcaagcug

SEQ ID NO: 73740 - RNA, 27 nt, Artificial Sequence
  Beta-parvin (274-282)
gaggugaccgaacuggagacacaguuc

SEQ ID NO: 73741 - RNA, 27 nt, Artificial Sequence
  Tankyrase-2 (358-366)
gaggugaccgaacugcucgucaagcac

SEQ ID NO: 73742 - RNA, 27 nt, Artificial Sequence
  RNA-binding protein 26 (806-814)
gaggugaccgaacugagaaggaaguac

SEQ ID NO: 73743 - RNA, 27 nt, Artificial Sequence
  Ribonucleoprotein PTB-binding 2 (177-185)
gaggugaccggccacagcaagggguac

SEQ ID NO: 73744 - RNA, 30 nt, Artificial Sequence
  Integrin alpha-X (448-457)
gaggugaccggcacacagaucgggagcuac

SEQ ID NO: 73745 - RNA, 27 nt, Artificial Sequence
  Catalase (10-18)
gaggugacccacgacaucacaaaguac

SEQ ID NO: 73746 - RNA, 27 nt, Artificial Sequence
  Plectin (3906-3914)
gaggugaccaagaaccugcagaaauuc

SEQ ID NO: 73747 - RNA, 27 nt, Artificial Sequence
  EH domain-binding protein 1 (186-194)
gaggugaccaagaacuacagaggcguc

SEQ ID NO: 73748 - RNA, 27 nt, Artificial Sequence
  Apoptosis-inducing factor 2 (169-177)
gaggugacccugauccacagccagguc

SEQ ID NO: 73749 - RNA, 33 nt, Artificial Sequence
  Ankyrin repeat and KH domain-containing protein 1 (1670-1680)
gaggugacccccaacagccuguccacaucuuac

SEQ ID NO: 73750 - RNA, 30 nt, Artificial Sequence
  Teneurin-4 (87-96)
gaggugacccccccucacggcacacuguac

SEQ ID NO: 73751 - RNA, 27 nt, Artificial Sequence
  Translocon-associated protein subunit gamma (99-107)
gaggugaccagaaagcugagcgaagcc

SEQ ID NO: 73752 - RNA, 27 nt, Artificial Sequence
  FAD synthase (63-71)
gaggugaccagcuucuccaacagauuu

SEQ ID NO: 73753 - RNA, 27 nt, Artificial Sequence
  Probable ATP-dependent RNA helicase DDX5 (30-38)
gaggugaccacagccagaagccaguuc

SEQ ID NO: 73754 - RNA, 27 nt, Artificial Sequence
  EH domain-binding protein 1-like protein 1 (1049-1057)
gaggugaccacaggcuacagagggguc

SEQ ID NO: 73755 - RNA, 27 nt, Artificial Sequence
  Formin-binding protein 4 (242-250)
gaggugaccugggaacugccccaguac

SEQ ID NO: 73756 - RNA, 27 nt, Artificial Sequence
  NGFI-A-binding protein 1 (307-315)
gaggugaccuacaaguauacauacaga

SEQ ID NO: 73757 - RNA, 30 nt, Artificial Sequence
  Serine/threonine-protein kinase TAO2 (52-61)
gagguggucgccaucaagaaaaugagcuac

SEQ ID NO: 73758 - RNA, 30 nt, Artificial Sequence
  Phosphatidate phosphatase LPIN1 (844-853)
gagguggucgaccacguuuucccccugcuc

SEQ ID NO: 73759 - RNA, 27 nt, Artificial Sequence
  Glutamate decarboxylase 1 (118-126)
gagguggucgacauccugcucaacuac

SEQ ID NO: 73760 - RNA, 30 nt, Artificial Sequence
  Nardilysin (988-997)
gagguggucgacaagaaaaucgaagaguuc

SEQ ID NO: 73761 - RNA, 27 nt, Artificial Sequence
  Lethal(3)malignant brain tumor-like protein 3 (457-465)
gagguggucgacaagagaaaccccaug

SEQ ID NO: 73762 - RNA, 39 nt, Artificial Sequence
  Contactin-associated protein-like 4 (182-194)
gagguggucgaccuggauggcaagagcucccuccuuuac

SEQ ID NO: 73763 - RNA, 27 nt, Artificial Sequence
  Translation initiation factor eIF-2B subunit gamma (116-124)
gagguggucgaccuguucagagccuac

SEQ ID NO: 73764 - RNA, 33 nt, Artificial Sequence
  Translation initiation factor eIF-2B subunit gamma (116-126)
gagguggucgaccuguucagagccuacgaugcu

SEQ ID NO: 73765 - RNA, 27 nt, Artificial Sequence
  Collagen triple helix repeat-containing protein 1 (46-54)
gagguggucgaccuguacaacggcaug

SEQ ID NO: 73766 - RNA, 33 nt, Artificial Sequence
  Unconventional myosin-X (2025-2035)
gagguggucgacguugccaagcugaugaaagcu

SEQ ID NO: 73767 - RNA, 36 nt, Artificial Sequence
  Unconventional myosin-X (2025-2036)
gagguggucgacguugccaagcugaugaaagcuuac

SEQ ID NO: 73768 - RNA, 33 nt, Artificial Sequence
  Gephyrin (726-736)
gagguggucgacguuauggugaucggcagacug

SEQ ID NO: 73769 - RNA, 27 nt, Artificial Sequence
  Guanine nucleotide-binding protein-like 3-like protein (181-189)
gagguggucgaaaaguggcuggacuac

SEQ ID NO: 73770 - RNA, 27 nt, Artificial Sequence
  Kinetochore protein Nuf2 (271-279)
gagguggucgaaaaguacgagaucuau

SEQ ID NO: 73771 - RNA, 27 nt, Artificial Sequence
  TBC1 domain family member 13 (209-217)
gagguggucgaaagaauccuguucauu

SEQ ID NO: 73772 - RNA, 33 nt, Artificial Sequence
  Putative ATP-dependent RNA helicase TDRD9 (906-916)
gagguggucgaaguuggccacuucuggggguac

SEQ ID NO: 73773 - RNA, 30 nt, Artificial Sequence
  Cytosolic non-specific dipeptidase (351-360)
gagguggucggcgaacagguuaccagcuac

SEQ ID NO: 73774 - RNA, 27 nt, Artificial Sequence
  Nuclear pore complex protein Nup160 (1025-1033)
gagguggucggcaucauugaaagcaga

SEQ ID NO: 73775 - RNA, 27 nt, Artificial Sequence
  Pseudopodium-enriched atypical kinase 1 (303-311)
gagguggucggcaagaucagaagccug

SEQ ID NO: 73776 - RNA, 33 nt, Artificial Sequence
  DCN1-like protein 5 (65-75)
gagguggucggccccgaagggauggagaaguuc

SEQ ID NO: 73777 - RNA, 30 nt, Artificial Sequence; identical to SEQ ID NO: 49550
  3 beta-hydroxysteroid dehydrogenase type 7 (131-140)

SEQ ID NO: 73778 - RNA, 27 nt, Artificial Sequence
  Tetratricopeptide repeat protein 5 (59-67)
gagguggucggcagcguucaggggaag

SEQ ID NO: 73779 - RNA, 33 nt, Artificial Sequence
  Diacylglycerol kinase theta (848-858)
gagguggucggcguuaccggggugguacacaug

SEQ ID NO: 73780 - RNA, 27 nt, Artificial Sequence
  WD repeat-containing protein 35 (735-743)
gagguggucggcuacuucgggagauuu

SEQ ID NO: 73781 - RNA, 27 nt, Artificial Sequence
  Signal transducer and activator of transcription 1-alpha/beta (212-220)
gaggugguccacaagaucauugaacug

SEQ ID NO: 73782 - RNA, 27 nt, Artificial Sequence
  Hemicentin-1 (5-13)
gaggugguccacaccguuuuccuguuu

SEQ ID NO: 73783 - RNA, 36 nt, Artificial Sequence
  Midasin (1181-1192)
gagguggucaaggcccaccccagauucaugcuguuu

SEQ ID NO: 73784 - RNA, 27 nt, Artificial Sequence
  Heat shock protein HSP 90-beta (126-134)
gagguggucaagaaacacagccaguuc

SEQ ID NO: 73785 - RNA, 27 nt, Artificial Sequence
  Peroxisomal multifunctional enzyme type 2 (641-649)
gagguggucaagaaaguuaacgccgug

SEQ ID NO: 73786 - RNA, 27 nt, Artificial Sequence
  39S ribosomal protein L21, mitochondrial (78-86)
gagguggucaagaaaguuaacgaaaug

SEQ ID NO: 73787 - RNA, 27 nt, Artificial Sequence
  Non-canonical poly(A) RNA polymerase PAPD7 (53-61)
gagguggucaagagaaucgaaaccguu

SEQ ID NO: 73788 - RNA, 39 nt, Artificial Sequence
  Radial spoke head 10 homolog B2 (158-170)
gagguggucaacggcaugagaaauggguucggaauguuu

SEQ ID NO: 73789 - RNA, 33 nt, Artificial Sequence
  DNA replication licensing factor MCM7 (92-102)
gagguggucaacaaggacguucuggauguguac

SEQ ID NO: 73790 - RNA, 27 nt, Artificial Sequence
  Unconventional myosin-Ib (290-298)
gagguggucaacaagaucaauagagcc

SEQ ID NO: 73791 - RNA, 42 nt, Artificial Sequence
  Protein ELYS (55-68)
gagguggucaacagcaucaccggcgaaagacuguccgccuac

SEQ ID NO: 73792 - RNA, 27 nt, Artificial Sequence
  Transcription factor SOX-13 (110-118)
gaggugguccccgccaucgaaaagcug

SEQ ID NO: 73793 - RNA, 27 nt, Artificial Sequence
  Cathepsin K (85-93)
gaggugguccagaagaugaccggccug

SEQ ID NO: 73794 - RNA, 27 nt, Artificial Sequence
  Protein C12orf4 (366-374)
gaggugguccagcaaguugugcuguac

SEQ ID NO: 73795 - RNA, 27 nt, Artificial Sequence
  Peptidylprolyl isomerase domain and WD repeat-containing protein 1 (616-624)
gaggugguccagagaaucagcaacguu

SEQ ID NO: 73796 - RNA, 45 nt, Artificial Sequence
  Proteasome subunit alpha type-7 (197-211)
gaggugguccagagcggcgggaagaacaucgaacuggccguuaug

SEQ ID NO: 73797 - RNA, 27 nt, Artificial Sequence
  E3 ubiquitin-protein ligase BRE1B (40-48)
gagguggucagagaaaccggcgaguac

SEQ ID NO: 73798 - RNA, 27 nt, Artificial Sequence
  Melanoma-associated antigen 12 (168-176)
gagguggucagaaucggccaccuguac

SEQ ID NO: 73799 - RNA, 27 nt, Artificial Sequence
  Unconventional myosin-IXb (955-963)
gagguggucagaaagauccugcuccuu

SEQ ID NO: 73800 - RNA, 30 nt, Artificial Sequence
  Cytoskeleton-associated protein 5 (88-97)
gagguggucagcggcguuguguccaaggua

SEQ ID NO: 73801 - RNA, 27 nt, Artificial Sequence
  Ubiquitin-conjugating enzyme E2 variant 3 (232-240)
gagguggucagccacaccucccagguu

SEQ ID NO: 73802 - RNA, 33 nt, Artificial Sequence
  RNA demethylase ALKBH5 (109-119)
gagguggucagcagagccgaaaagggccuguac

SEQ ID NO: 73803 - RNA, 30 nt, Artificial Sequence
  Integrator complex subunit 1 (1714-1723)
gagguggucagcuccaccguuagagccgug

SEQ ID NO: 73804 - RNA, 33 nt, Artificial Sequence
  Cullin-3 (55-65)
gagguggucaccgaacaccugaucaacaagguu

SEQ ID NO: 73805 - RNA, 33 nt, Artificial Sequence
  Ankyrin repeat and zinc finger domain-containing protein 1 (16-26)
gagguggucacccacaagacauuccauagauac

SEQ ID NO: 73806 - RNA, 30 nt, Artificial Sequence
  Cyclin-dependent kinase 2 (224-233)
gagguggucuggcccggcguuaccagcaug

SEQ ID NO: 73807 - RNA, 39 nt, Artificial Sequence
  Contactin-associated protein-like 3B (182-194)
gagguggucuacuucgacggccagagcgcccugcucuau

SEQ ID NO: 73808 - RNA, 27 nt, Artificial Sequence
  DDB1- and CUL4-associated factor 7 (176-184)
gagguguacgacaucgccuucagcaga

SEQ ID NO: 73809 - RNA, 30 nt, Artificial Sequence
  DDB1- and CUL4-associated factor 7 (176-185)
gagguguacgacaucgccuucagcagagcu

SEQ ID NO: 73810 - RNA, 36 nt, Artificial Sequence
  Melanotransferrin (97-108)
gagguguacgaccaggaagucggcaccagcuauuac

SEQ ID NO: 73811 - RNA, 30 nt, Artificial Sequence
  Nuclear pore complex protein Nup155 (1301-1310)
gagguguacgaccagcuguucaagagcaga

SEQ ID NO: 73812 - RNA, 27 nt, Artificial Sequence
  Protein polybromo-1 (670-678)
gagguguacgaagccgucaagaacuau

SEQ ID NO: 73813 - RNA, 30 nt, Artificial Sequence
  DNA-directed RNA polymerase, mitochondrial (459-468)
gagguguacgaaggcagauucagccuguau

SEQ ID NO: 73814 - RNA, 33 nt, Artificial Sequence
  DNA-directed RNA polymerase, mitochondrial (459-469)
gagguguacgaaggcagauucagccuguauccc

SEQ ID NO: 73815 - RNA, 30 nt, Artificial Sequence
  Tyrosine-protein kinase ABL1 (255-264)
gagguguacgaaggcgucuggaagaaauau

SEQ ID NO: 73816 - RNA, 30 nt, Artificial Sequence
  Protein lin-7 homolog C (52-61)
gagguguacgaacacgucuaugagaccguu

SEQ ID NO: 73817 - RNA, 27 nt, Artificial Sequence
  Zinc finger protein 292 (337-345)
gagguguacgaaaaggucguugacuau

SEQ ID NO: 73818 - RNA, 33 nt, Artificial Sequence
  Muscular LMNA-interacting protein (350-360)
gagguguacgaacccaacccuuucagcaaguau

SEQ ID NO: 73819 - RNA, 27 nt, Artificial Sequence
  rRNA methyltransferase 2, mitochondrial (229-237)
gagguguacuuccuggccacccaguau

SEQ ID NO: 73820 - RNA, 30 nt, Artificial Sequence; identical to SEQ ID NO: 49593
  Large neutral amino acids transporter small subunit 1 (122-131)

SEQ ID NO: 73821 - RNA, 36 nt, Artificial Sequence
  Procollagen-lysine,2-oxoglutarate 5-dioxygenase 2 (336-347)
gagguguaccacgaaaaggacaucaaagucuucuuu

SEQ ID NO: 73822 - RNA, 30 nt, Artificial Sequence
  Nucleoside diphosphate kinase 7 (250-259)
gagguguacaagggcgucguuaccgaauau

SEQ ID NO: 73823 - RNA, 33 nt, Artificial Sequence
  Ras GTPase-activating-like protein IQGAP3 (1166-1176)
gagguguacaaggucguuggcaaccugcucuau

SEQ ID NO: 73824 - RNA, 30 nt, Artificial Sequence
  Kinesin-like protein KIF14 (5-14)
gagguguacaacgaaaagauccacgaccug

SEQ ID NO: 73825 - RNA, 30 nt, Artificial Sequence
  Kinesin-like protein KIF18B (166-175)
gagguguacaacgaacagauccacgaccug

SEQ ID NO: 73826 - RNA, 30 nt, Artificial Sequence
  Kinesin-like protein KIF18A (161-170)
gagguguacaacgaacagaucagagaccug

SEQ ID NO: 73827 - RNA, 27 nt, Artificial Sequence
  F-box only protein 32 (44-52)
gagguguacaacaaggaaaaucuguuc

SEQ ID NO: 73828 - RNA, 39 nt, Artificial Sequence
  Tyrosinase (409-421)
gagguguaccccgaagccaacgcuccuaucggccacaau

SEQ ID NO: 73829 - RNA, 36 nt, Artificial Sequence
  Ubiquitin carboxyl-terminal hydrolase 11 (150-161)
gagguguaccccgucgaacugcuccuuguuagacac

SEQ ID NO: 73830 - RNA, 27 nt, Artificial Sequence
  E3 ubiquitin-protein ligase UBR2 (37-45)
gagguguaccagcaccuggcccauuau

SEQ ID NO: 73831 - RNA, 30 nt, Artificial Sequence
  Small nuclear ribonucleoprotein Sm D3 (26-35)
gagguguacagaggcaagcugaucgaagcc

SEQ ID NO: 73832 - RNA, 30 nt, Artificial Sequence
  Transmembrane protein 201 (151-160)
gagguguacagacaccaucuggaacagaug

SEQ ID NO: 73833 - RNA, 33 nt, Artificial Sequence
  Pre-mRNA-processing-splicing factor 8 (2324-2334)
gagguguacagcgccgacagagaagaucuguau

SEQ ID NO: 73834 - RNA, 33 nt, Artificial Sequence
  Semaphorin-7A (114-124)
gagguguacagcaccaucagaaagcaggaauau

SEQ ID NO: 73835 - RNA, 33 nt, Artificial Sequence
  cAMP-dependent protein kinase type I-alpha regulatory subunit (103-113)
gagguguacaccgaagaggacgccgcuagcuau

SEQ ID NO: 73836 - RNA, 30 nt, Artificial Sequence
  Arf-GAP with Rho-GAP domain, ANK repeat and PH domain-containing protein 1 (574-583)
gagguguacaccgaaggcgagagacuguau

SEQ ID NO: 73837 - RNA, 30 nt, Artificial Sequence; identical to SEQ ID NO: 49610
  DNA repair endonuclease XPF (99-108)

SEQ ID NO: 73838 - RNA, 30 nt, Artificial Sequence
  Signal transducer and activator of transcription 2 (831-840)
gagguguacgucagcagacccucccacuuc

SEQ ID NO: 73839 - RNA, 33 nt, Artificial Sequence
  Signal transducer and activator of transcription 2 (831-841)
gagguguacgucagcagacccucccacuucuau

SEQ ID NO: 73840 - RNA, 27 nt, Artificial Sequence
  Phospholipase A-2-activating protein (168-176)
gagguguacuauggccacaccaacuac

SEQ ID NO: 73841 - RNA, 33 nt, Artificial Sequence
  Phospholipase A-2-activating protein (168-178)
gagguguacuauggccacaccaacuacaucuau

SEQ ID NO: 73842 - RNA, 27 nt, Artificial Sequence
  Protein virilizer homolog (485-493)
uucgccgaccacgugagcuccucucug

SEQ ID NO: 73843 - RNA, 27 nt, Artificial Sequence
  CLIP-associating protein 1 (877-885)
uucgccgacccccacagcaagagagug

SEQ ID NO: 73844 - RNA, 30 nt, Artificial Sequence
  CLIP-associating protein 1 (877-886)
uucgccgacccccacagcaagagaguguuu

SEQ ID NO: 73845 - RNA, 27 nt, Artificial Sequence
  Calmodulin-regulated spectrin-associated protein 2 (673-681)
uucgccgagcagaaguuuagaaaacug

SEQ ID NO: 73846 - RNA, 30 nt, Artificial Sequence
  Sorting nexin-17 (460-469)
uucgccuuugagggcaucggggacgaagau

SEQ ID NO: 73847 - RNA, 27 nt, Artificial Sequence
  Melanoma-associated antigen C1 (1035-1043)
uucgccuuuggcgagcccagagaacug

SEQ ID NO: 73848 - RNA, 48 nt, Artificial Sequence
  POTE ankyrin domain family member F (721-736)
uucgccggcgacgaugcucccagagcaguguuuccuagcaucgucggg

SEQ ID NO: 73849 - RNA, 33 nt, Artificial Sequence
  Up-regulator of cell proliferation (600-610)
uucgcccacuuucccggccuggcuagcgagcuc

SEQ ID NO: 73850 - RNA, 27 nt, Artificial Sequence
  Glycerol-3-phosphate dehydrogenase, mitochondrial (27-35)
uucgcccacuacagaaggaagcagaug

SEQ ID NO: 73851 - RNA, 24 nt, Artificial Sequence
  Alpha-catulin (24-31)
uucgcccuggacagcggccucgag

SEQ ID NO: 73852 - RNA, 33 nt, Artificial Sequence; identical to SEQ ID NO: 49625
  Melanocyte protein PMEL (247-257)

SEQ ID NO: 73853 - RNA, 30 nt, Artificial Sequence
  Eukaryotic translation initiation factor 3 subunit E (53-62)
uucgccauggacguguacaagaaccuguau

SEQ ID NO: 73854 - RNA, 27 nt, Artificial Sequence
  NHL repeat-containing protein 2 (407-415)
uucgcccagcccagcggccugucccuc

SEQ ID NO: 73855 - RNA, 27 nt, Artificial Sequence
  Dynactin subunit 1 (1206-1214)
uucgccaccuuucccagcuccgcuuuc

SEQ ID NO: 73856 - RNA, 24 nt, Artificial Sequence
  Translocon-associated protein subunit gamma (75-82)
uucgccuacaagaacgugaaauuu

SEQ ID NO: 73857 - RNA, 36 nt, Artificial Sequence
  Protein disulfide-isomerase A3 (160-171)
uucgacgauagcuuuuccgaggcccacucugaauuc

SEQ ID NO: 73858 - RNA, 27 nt, Artificial Sequence
  Phosphatidylinositol 3,4,5-trisphosphate 3-phosphatase and dual-specificity protein phosphatase PTEN (90-98)
uucgaggaccacaaccccccucagcug

SEQ ID NO: 73859 - RNA, 45 nt, Artificial Sequence
  Keratin, type I cytoskeletal 9 (465-479)
uucgagagcuccggcgccgggaagaucggacuggguggcagaggg

SEQ ID NO: 73860 - RNA, 48 nt, Artificial Sequence
  Keratin, type I cytoskeletal 9 (465-480)
uucgagagcuccggcgccgggaagaucggacuggguggcagaggggga

SEQ ID NO: 73861 - RNA, 36 nt, Artificial Sequence
  Interleukin enhancer-binding factor 3 (693-704)
uucuuuaccgacugcuacggcuaucacgauuucggg

SEQ ID NO: 73862 - RNA, 42 nt, Artificial Sequence
  Interleukin enhancer-binding factor 3 (693-706)
uucuuuaccgacugcuacggcuaucacgauuucgggagcucc

SEQ ID NO: 73863 - RNA, 30 nt, Artificial Sequence
  Apolipoprotein B-100 (2396-2405)
uucaucgacgaugccgugaagaaacugaac

SEQ ID NO: 73864 - RNA, 27 nt, Artificial Sequence
  Probable tRNA (uracil-O(2)-)-methyltransferase (608-616)
uucaucgaccaggugguccugcaaguu

SEQ ID NO: 73865 - RNA, 33 nt, Artificial Sequence
  Plexin-A2 (789-799)
uucaucauugacaacccccaggaucugaaggug

SEQ ID NO: 73866 - RNA, 39 nt, Artificial Sequence
  Filamin-A (2041-2053)
uucaucauugacaccagagaugccggcuacgggggacug

SEQ ID NO: 73867 - RNA, 45 nt, Artificial Sequence
  Filamin-A (2041-2055)
uucaucauugacaccagagaugccggcuacgggggacugagccuc

SEQ ID NO: 73868 - RNA, 27 nt, Artificial Sequence
  Uncharacterized protein CXorf57 (552-560)
uucauccuguuuuucuacggcagcgac

SEQ ID NO: 73869 - RNA, 33 nt, Artificial Sequence
  Sorting nexin-14 (234-244)
uuccuggccgaccccgauaccgugaaccaccuc

SEQ ID NO: 73870 - RNA, 36 nt, Artificial Sequence
  Protein YIF1B (69-80)
uuccuggccgaccccgugagcaacauggcuauggca

SEQ ID NO: 73871 - RNA, 30 nt, Artificial Sequence
  Class E basic helix-loop-helix protein 41 (366-375)
uuccuggacaagagcggccucgagaaauac

SEQ ID NO: 73872 - RNA, 36 nt, Artificial Sequence
  Class E basic helix-loop-helix protein 41 (366-377)
uuccuggacaagagcggccucgagaaauaccuuuau

SEQ ID NO: 73873 - RNA, 30 nt, Artificial Sequence
  Ceramide synthase 1 (207-216)
uuccugcacgacaucagcgaugugcagcuc

SEQ ID NO: 73874 - RNA, 27 nt, Artificial Sequence
  Exostosin-2 (253-261)
uuccugcucagcucccaggugggccuu

SEQ ID NO: 73875 - RNA, 33 nt, Artificial Sequence
  Uncharacterized protein C15orf61 (147-157)
uuccugaacaaggaggacgaaggcgccauguac

SEQ ID NO: 73876 - RNA, 27 nt, Artificial Sequence
  Spatacsin (617-625)
uuccugaacaaucagaucaaggagcuc

SEQ ID NO: 73877 - RNA, 27 nt, Artificial Sequence
  2',3'-cyclic-nucleotide 3'-phosphodiesterase (12-20)
uuccugcccaagaucuuuuucagaaaa

SEQ ID NO: 73878 - RNA, 33 nt, Artificial Sequence
  Polyphosphoinositide phosphatase (404-414)
uuccugcccccugagcacaccaucguguacauu

SEQ ID NO: 73879 - RNA, 30 nt, Artificial Sequence
  Alpha/beta hydrolase domain-containing protein 17C (35-44)
uuccugcccccugagccaaccuacacagug

SEQ ID NO: 73880 - RNA, 33 nt, Artificial Sequence
  Zinc finger protein with KRAB and SCAN domains 1 (104-114)
uuccugagcauccuccccaaggagcuucaggug

SEQ ID NO: 73881 - RNA, 30 nt, Artificial Sequence; identical to SEQ ID NO: 49654
  Presenilin-2 (437-446)

SEQ ID NO: 73882 - RNA, 33 nt, Artificial Sequence; identical to SEQ ID NO: 49655
  Presenilin-2 (437-447)

SEQ ID NO: 73883 - RNA, 36 nt, Artificial Sequence; identical to SEQ ID NO: 49656
  Presenilin-2 (437-448)

SEQ ID NO: 73884 - RNA, 33 nt, Artificial Sequence
  Protein tyrosine phosphatase type IVA 1 (23-33)
uucauggaguuucugaagggcagcggggacuac

SEQ ID NO: 73885 - RNA, 27 nt, Artificial Sequence
  SHC-transforming protein 4 (33-41)
uucagaaacgagagcaucaccucccug

SEQ ID NO: 73886 - RNA, 30 nt, Artificial Sequence
  Caprin-1 (656-665)
uucagcgcccccagagacuacuccggcuau

SEQ ID NO: 73887 - RNA, 27 nt, Artificial Sequence
  Uncharacterized protein CXorf23 (6-14)
uucagcgacggcagaacccagaaguac

SEQ ID NO: 73888 - RNA, 36 nt, Artificial Sequence
  DNA-directed RNA polymerase I subunit RPA2 (493-504)
uucagcgaccacaaccagucccccagaaauauguac

SEQ ID NO: 73889 - RNA, 33 nt, Artificial Sequence
  Serine/threonine-protein kinase RIO2 (416-426)
uucagcgaggaaaagaacagaaccgagaauuac

SEQ ID NO: 73890 - RNA, 30 nt, Artificial Sequence; identical to SEQ ID NO: 49663
  Tubulin alpha-1C chain (18-27)

SEQ ID NO: 73891 - RNA, 24 nt, Artificial Sequence
  Nucleosome assembly protein 1-like 1 (245-252)
uucagcuuugacggccccgagauc

SEQ ID NO: 73892 - RNA, 30 nt, Artificial Sequence
  RNA-binding protein EWS (285-294)
uucagcggccccggggagaacagauccaug

SEQ ID NO: 73893 - RNA, 27 nt, Artificial Sequence
  40S ribosomal protein S27 (111-119)
uucagccacgcccagaccgugguccug

SEQ ID NO: 73894 - RNA, 27 nt, Artificial Sequence
  ADP-ribose pyrophosphatase, mitochondrial (257-265)
uucagccaggaccaccuggugaucuac

SEQ ID NO: 73895 - RNA, 51 nt, Artificial Sequence
  PERQ amino acid-rich with GYF domain-containing protein 2 (1273-1289)
uucagcgugaacgccuccucugagagacugaauaugggcgaaaucgagacc

SEQ ID NO: 73896 - RNA, 33 nt, Artificial Sequence
  Serine/threonine-protein kinase Sgk1 (516-526)
uucagcuacgcccccccuaccgacuccuuucug

SEQ ID NO: 73897 - RNA, 33 nt, Artificial Sequence
  Transcription factor SOX-10 (425-435)
uucagcuacaugggccccucccagagaccucug

SEQ ID NO: 73898 - RNA, 33 nt, Artificial Sequence
  Protein argonaute-3 (775-785)
uucaccgccgacgagcugcagcuccuuacauac

SEQ ID NO: 73899 - RNA, 27 nt, Artificial Sequence
  Protein FAM102B (9-17)
uucaccgccgagagcuccagagaagug

SEQ ID NO: 73900 - RNA, 27 nt, Artificial Sequence
  Dipeptidyl peptidase 2 (373-381)
uucaccgacgagcugagacagagguac

SEQ ID NO: 73901 - RNA, 27 nt, Artificial Sequence
  Membrane-associated transporter protein (338-346)
uucaccgacuuuaugggccagaucgug

SEQ ID NO: 73902 - RNA, 30 nt, Artificial Sequence
  Membrane-associated transporter protein (338-347)
uucaccgacuuuaugggccagaucguguac

SEQ ID NO: 73903 - RNA, 24 nt, Artificial Sequence
  Probable guanine nucleotide exchange factor MCF2L2 (62-69)
uucaccgacaucggcauuaaguac

SEQ ID NO: 73904 - RNA, 30 nt, Artificial Sequence
  Testis-expressed sequence 10 protein (107-116)
uucaccgacaaggaugccaacgugagacug

SEQ ID NO: 73905 - RNA, 27 nt, Artificial Sequence
  Semaphorin-5A (1065-1073)
uucaccgaccugaacaauuacgaugag

SEQ ID NO: 73906 - RNA, 30 nt, Artificial Sequence
  Semaphorin-5A (1065-1074)
uucaccgaccugaacaauuacgaugaguau

SEQ ID NO: 73907 - RNA, 27 nt, Artificial Sequence
  Tubulin polyglutamylase complex subunit 1 (17-25)
uucaccgacagcggcagacaguccgug

SEQ ID NO: 73908 - RNA, 33 nt, Artificial Sequence
  Leucine-rich repeat-containing protein 42 (128-138)
uucaccgagcccggcgccgggcugagagcucuc

SEQ ID NO: 73909 - RNA, 27 nt, Artificial Sequence
  AF4/FMR2 family member 1 (3-11)
uucaccgagagagugaacagcuccggc

SEQ ID NO: 73910 - RNA, 21 nt, Artificial Sequence
  von Willebrand factor A domain-containing protein 9 (129-135)
uucaccaucgacggcccccug

SEQ ID NO: 73911 - RNA, 27 nt, Artificial Sequence
  Elongator complex protein 1 (934-942)
uucaccaucgacaaguaccugaaaaga

SEQ ID NO: 73912 - RNA, 51 nt, Artificial Sequence
  Melanocyte protein PMEL (214-230)
uucaccaucacagaccaggugcccuuuagcgucuccguuucucaacugaga

SEQ ID NO: 73913 - RNA, 33 nt, Artificial Sequence
  Hypoxia-inducible factor 1-alpha (295-305)
uucaccaagggccaggugacaacugggcaauac

SEQ ID NO: 73914 - RNA, 27 nt, Artificial Sequence
  Ropporin-1B (203-211)
uucacccagaaccccagaguguggcug

SEQ ID NO: 73915 - RNA, 24 nt, Artificial Sequence
  Nephrocystin-4 (1264-1271)
uucaccagccacccccaggagcug

SEQ ID NO: 73916 - RNA, 27 nt, Artificial Sequence
  Very-long-chain enoyl-CoA reductase (119-127)
uucaccagcuccagacacacagugguc

SEQ ID NO: 73917 - RNA, 27 nt, Artificial Sequence
  Cytoplasmic dynein 2 heavy chain 1 (2484-2492)
uucaccguggacgauuacagccacuau

SEQ ID NO: 73918 - RNA, 45 nt, Artificial Sequence
  Cleft lip and palate transmembrane protein 1-like protein (157-171)
uucguguuugacggcagcucccugcccgccgauguccacagauac

SEQ ID NO: 73919 - RNA, 33 nt, Artificial Sequence
  TNF receptor-associated factor 4 (202-212)
uucguguuugacaccauccagagccaccaauac

SEQ ID NO: 73920 - RNA, 27 nt, Artificial Sequence
  NADH dehydrogenase (ubiquinone) 1 beta subcomplex subunit 1 (32-40)
uucgugaucggcugcuaccuggacaga

SEQ ID NO: 73921 - RNA, 33 nt, Artificial Sequence
  FAD-dependent oxidoreductase domain-containing protein 2 (493-503)
uucgugaucaacauggaguacggcagaaauuuu

SEQ ID NO: 73922 - RNA, 27 nt, Artificial Sequence
  Ran GTPase-activating protein 1 (562-570)
uucgugaccaagcccaacagcgcccug

SEQ ID NO: 73923 - RNA, 27 nt, Artificial Sequence
  Long-chain-fatty-acid-CoA ligase 3 (624-632)
uucgugguccccaaccagaaggagcug

SEQ ID NO: 73924 - RNA, 30 nt, Artificial Sequence
  Mitochondrial folate transporter/carrier (297-306)
uucguggucuacgagaacguuagccacuuu

SEQ ID NO: 73925 - RNA, 30 nt, Artificial Sequence
  F-box only protein 21 (602-611)
uucguguacgagaccguccagaacaucuau

SEQ ID NO: 73926 - RNA, 33 nt, Artificial Sequence
  Transmembrane protein 181 (554-564)
uucguguacagccccuccaagaacgcccuguau

SEQ ID NO: 73927 - RNA, 27 nt, Artificial Sequence
  GDP-fucose protein O-fucosyltransferase 1 (2-10)
ggcgccgcugcaugggccagaccccug

SEQ ID NO: 73928 - RNA, 27 nt, Artificial Sequence
  Zinc finger and BTB domain-containing protein 7A (137-145)
ggcgccgacgcugggcagcuggaucuc

SEQ ID NO: 73929 - RNA, 30 nt, Artificial Sequence
  3'(2'),5'-bisphosphate nucleotidase 1 (176-185)
ggcgccuucggguuucagcugaaggaggug

SEQ ID NO: 73930 - RNA, 27 nt, Artificial Sequence
  X-ray repair cross-complementing protein 5 (469-477)
ggcgcccacuucagcguguccucucug

SEQ ID NO: 73931 - RNA, 27 nt, Artificial Sequence
  Replication protein A 70 kDa DNA-binding subunit (8-16)
ggcgccaucgcugcaauuaugcagaag

SEQ ID NO: 73932 - RNA, 27 nt, Artificial Sequence
  WD repeat-containing protein 89 (351-359)
ggcgccaucgagaagaccuucacaaaa

SEQ ID NO: 73933 - RNA, 33 nt, Artificial Sequence
  Elongation factor 2 (190-200)
ggcgcccugugcgaggaaaacaugagaggggug

SEQ ID NO: 73934 - RNA, 27 nt, Artificial Sequence
  NHP2-like protein 1 (38-46)
ggcgccaacgaggcuaccaagacacug

SEQ ID NO: 73935 - RNA, 39 nt, Artificial Sequence
  Nestin (515-527)
ggcgcccccgugcaccuggggcagggacaauuccucaag

SEQ ID NO: 73936 - RNA, 51 nt, Artificial Sequence
  Galectin-1 (66-82)
ggcgccugggggaccgagcagagagaagcuguguuccccuuucaaccugga

SEQ ID NO: 73937 - RNA, 27 nt, Artificial Sequence
  Calcium-transporting ATPase type 2C member 1 (481-489)
ggcgccuacgagcaggugaucaaguau

SEQ ID NO: 73938 - RNA, 27 nt, Artificial Sequence
  Delta(24)-sterol reductase (349-357)
ggcgccuacggggagcccagagugaag

SEQ ID NO: 73939 - RNA, 27 nt, Artificial Sequence
  Ribosomal protein S6 kinase alpha-5 (58-66)
ggcgccuacgggaagguguuccugguc

SEQ ID NO: 73940 - RNA, 45 nt, Artificial Sequence
  Heterogeneous nuclear ribonucleoprotein F (26-40)
ggcgccuacagcucccaggugaugcaagggaugggagucucugcu

SEQ ID NO: 73941 - RNA, 27 nt, Artificial Sequence
  Complement factor H-related protein 2 (34-42)
ggcgacaucaccagcuuccugcucucc

SEQ ID NO: 73942 - RNA, 27 nt, Artificial Sequence
  Protein SMG8 (168-176)
ggcgaggccgggggaggucugagccuc

SEQ ID NO: 73943 - RNA, 36 nt, Artificial Sequence
  Cytoplasmic dynein 1 heavy chain 1 (2969-2980)
ggcgaggacuucgaugaagaccugagaaccgugcuc

SEQ ID NO: 73944 - RNA, 30 nt, Artificial Sequence
  Cytoplasmic dynein 1 light intermediate chain 1 (74-83)
ggcgaggacggggccggaaagaccagccug

SEQ ID NO: 73945 - RNA, 27 nt, Artificial Sequence
  Neural cell adhesion molecule L1 (1050-1058)
ggcgaggaaaaggggggagccagccug

SEQ ID NO: 73946 - RNA, 27 nt, Artificial Sequence
  HEAT repeat-containing protein 5B (1966-1974)
ggcgaggaacagaacagagugcaacug

SEQ ID NO: 73947 - RNA, 33 nt, Artificial Sequence
  Rho guanine nucleotide exchange factor 2 (798-808)
ggcgaggaaagagccaccgaggcugggagccug

SEQ ID NO: 73948 - RNA, 27 nt, Artificial Sequence
  Chondroitin sulfate synthase 2 (169-177)
ggcgaggaaagacccaucgggcaccug

SEQ ID NO: 73949 - RNA, 30 nt, Artificial Sequence
  CD276 antigen (290-299)
ggcgagggggaaggaagcaagaccgcccug

SEQ ID NO: 73950 - RNA, 27 nt, Artificial Sequence
  Ras GTPase-activating-like protein IQGAP1 (1300-1308)
ggcgagaucauuaacacccacacacug

SEQ ID NO: 73951 - RNA, 27 nt, Artificial Sequence
  Bifunctional 3'-phosphoadenosine 5'-phosphosulfate synthase 2 (170-178)
ggcgagaucaagggguucaccggaauu

SEQ ID NO: 73952 - RNA, 33 nt, Artificial Sequence
  Serine/threonine-protein kinase TBK1 (496-506)
ggcgagaucagcgacauucacaccaagcugcuc

SEQ ID NO: 73953 - RNA, 30 nt, Artificial Sequence
  Leucine zipper putative tumor suppressor 2 (448-457)
ggcgagaucagccugcucaagcagcaacuu

SEQ ID NO: 73954 - RNA, 33 nt, Artificial Sequence
  DNA-directed RNA polymerase III subunit RPC3 (18-28)
ggcgagaucguggaaaagauugggguccaccug

SEQ ID NO: 73955 - RNA, 27 nt, Artificial Sequence
  Coatomer subunit beta' (652-660)
ggcgagcugaagaucgccuaccagcuc

SEQ ID NO: 73956 - RNA, 27 nt, Artificial Sequence
  DNA topoisomerase 3-beta-1 (168-176)
ggcgagcccgaccacaacgaagcccug

SEQ ID NO: 73957 - RNA, 36 nt, Artificial Sequence
  Ras-related protein Rab-5A (27-38)
ggcgagagcgccguggggaaguccucucugguccuc

SEQ ID NO: 73958 - RNA, 27 nt, Artificial Sequence
  Hemicentin-1 (1905-1913)
ggcgagacccagcaacacauccagcug

SEQ ID NO: 73959 - RNA, 27 nt, Artificial Sequence
  NF-kappa-B inhibitor beta (105-113)
ggcgagaccagcacaguggaaaagcug

SEQ ID NO: 73960 - RNA, 27 nt, Artificial Sequence
  Probable N-acetyltransferase 16 (116-124)
ggcgagaccgugcuggucgaagggcuc

SEQ ID NO: 73961 - RNA, 39 nt, Artificial Sequence
  5,6-dihydroxyindole-2-carboxylic acid oxidase (209-221)
ggcgagguggacuucagccacgaagggcccgccuuucug

SEQ ID NO: 73962 - RNA, 33 nt, Artificial Sequence
  Unconventional myosin-X (1723-1733)
ggcgagguggucgaaaagcugaucagagggcuc

SEQ ID NO: 73963 - RNA, 30 nt, Artificial Sequence
  Ornithine aminotransferase, mitochondrial (121-130)
ggcgaguacgaagaguauaucaccaagcug

SEQ ID NO: 73964 - RNA, 27 nt, Artificial Sequence
  Carbonic anhydrase-related protein (45-53)
ggcgaguaccagagccccaucaaccug

SEQ ID NO: 73965 - RNA, 51 nt, Artificial Sequence
  Peptidyl-prolyl cis-trans isomerase A (64-80)
ggcggggacuucaccagacacaacggaacagguggcaagagcaucuacggg

SEQ ID NO: 73966 - RNA, 42 nt, Artificial Sequence
  NEDD8-conjugating enzyme Ubc12 (170-183)
ggcggguacaucggaagcaccuauuucgagagaugccugaag

SEQ ID NO: 73967 - RNA, 30 nt, Artificial Sequence
  Fibrocystin-L (2531-2540)
ggcaucgagcacgggaacauucugcaguac

SEQ ID NO: 73968 - RNA, 27 nt, Artificial Sequence
  Polypeptide N-acetylgalactosaminyltransferase 16 (295-303)
ggcaucuucgugauugacaagagcugg

SEQ ID NO: 73969 - RNA, 30 nt, Artificial Sequence
  2'-5'-oligoadenylate synthase-like protein (493-502)
ggcauccaggacagcgauacccugauucuc

SEQ ID NO: 73970 - RNA, 27 nt, Artificial Sequence
  60S ribosomal protein L37a (8-16)
ggcaucguggggaaguacggaaccaga

SEQ ID NO: 73971 - RNA, 27 nt, Artificial Sequence
  Intraflagellar transport protein 172 homolog (129-137)
ggccuggccgaggggaaggugagacuc

SEQ ID NO: 73972 - RNA, 27 nt, Artificial Sequence
  Pre-B-cell leukemia transcription factor-interacting protein 1 (428-436)
ggccuggccgagcucgggcacagacuu

SEQ ID NO: 73973 - RNA, 27 nt, Artificial Sequence
  NADH dehydrogenase (ubiquinone) 1 alpha subcomplex subunit 1 (20-28)
ggccuggccaccgcuuacauccacaga

SEQ ID NO: 73974 - RNA, 27 nt, Artificial Sequence
  Selenocysteine insertion sequence-binding protein 2-like (751-759)
ggccuggacgaggcccucuacaacgug

SEQ ID NO: 73975 - RNA, 27 nt, Artificial Sequence
  Solute carrier family 25 member 33 (93-101)
ggccuggggcccaaccucgugggaguc

SEQ ID NO: 73976 - RNA, 24 nt, Artificial Sequence
  Lysine-specific demethylase 3A (124-131)
ggccuggggagcaucaccuccgug

SEQ ID NO: 73977 - RNA, 27 nt, Artificial Sequence
  Membrane-associated transporter protein (409-417)
ggccuggggaccggauucaucggucuc

SEQ ID NO: 73978 - RNA, 27 nt, Artificial Sequence
  Plectin (546-554)
ggccugcaccagagcaucgaggaauuc

SEQ ID NO: 73979 - RNA, 27 nt, Artificial Sequence
  Filamin-A (1300-1308)
ggccugcacagcguggacgucaccuac

SEQ ID NO: 73980 - RNA, 36 nt, Artificial Sequence
  Ubiquitin-conjugating enzyme E2 G1 (28-39)
ggccugaucgacgauaacgaccucuacagaugggag

SEQ ID NO: 73981 - RNA, 27 nt, Artificial Sequence
  Dedicator of cytokinesis protein 11 (1172-1180)
ggccugcuccuugagaacauccagaga

SEQ ID NO: 73982 - RNA, 33 nt, Artificial Sequence
  ATP-dependent RNA helicase DDX1 (121-131)
ggccugaugaaggggaaacacuacuaugaggug

SEQ ID NO: 73983 - RNA, 27 nt, Artificial Sequence
  U7 snRNA-associated Sm-like protein LSm10 (23-31)
ggccugcaggggagagugaccacaguc

SEQ ID NO: 73984 - RNA, 27 nt, Artificial Sequence
  Mortality factor 4-like protein 1 (100-108)
ggccugcagcaaaagaacguggagguc

SEQ ID NO: 73985 - RNA, 21 nt, Artificial Sequence
  Microtubule-associated protein 1B (225-231)
ggccugagcgaguucaccgaa

SEQ ID NO: 73986 - RNA, 27 nt, Artificial Sequence
  Pterin-4-alpha-carbinolamine dehydratase (12-20)
ggccugagcgagagagacaucaaccuc

SEQ ID NO: 73987 - RNA, 27 nt, Artificial Sequence
  Protein-methionine sulfoxide oxidase MICAL3 (1054-1062)
ggccugagcgaggugcucguccagauc

SEQ ID NO: 73988 - RNA, 27 nt, Artificial Sequence
  Probable E3 ubiquitin-protein ligase HERC1 (3214-3222)
ggccugaccgacaucagaacacucgug

SEQ ID NO: 73989 - RNA, 33 nt, Artificial Sequence
  Zinc transporter ZIP14 (20-30)
ggccuguggagaaccacacccgaggcccacgcu

SEQ ID NO: 73990 - RNA, 33 nt, Artificial Sequence
  Prolyl 3-hydroxylase 2 (87-97)
ggccuguacgaggccaucgcugaccacuauaug

SEQ ID NO: 73991 - RNA, 30 nt, Artificial Sequence
  Guanine nucleotide-binding protein-like 3-like protein (377-386)
ggccuguacagccaggagcaagccgcuaag

SEQ ID NO: 73992 - RNA, 27 nt, Artificial Sequence
  Tuberin (1302-1310)
ggcauggacagaaggaccgaugccuac

SEQ ID NO: 73993 - RNA, 33 nt, Artificial Sequence
  Unconventional myosin-Va (1628-1638)
ggcaugcuggagcacgaaaccauccagggggug

SEQ ID NO: 73994 - RNA, 51 nt, Artificial Sequence
  Spectrin alpha chain, non-erythrocytic 1 (367-383)
ggcaugaugcccagagacgagaccgauagcaagacagccuccccuuggaaa

SEQ ID NO: 73995 - RNA, 27 nt, Artificial Sequence
  Solute carrier family 35 member E1 (21-29)
ggcaugaugaccgccauccugggggug

SEQ ID NO: 73996 - RNA, 27 nt, Artificial Sequence
  Catenin beta-1 (106-114)
ggcaugcagauccccagcacccaauuc

SEQ ID NO: 73997 - RNA, 51 nt, Artificial Sequence
  Autophagy-related protein 2 homolog A (1914-1930)
ggcaugagaaaccagaucgugcccgacgcccacaaggaucaugcucugaaa

SEQ ID NO: 73998 - RNA, 27 nt, Artificial Sequence
  Synaptic vesicle membrane protein VAT-1 homolog (137-145)
ggcauguggcaggaggaagugaccguc

SEQ ID NO: 73999 - RNA, 36 nt, Artificial Sequence
  BMP and activin membrane-bound inhibitor homolog (249-260)
ggcauguacagcgggcacggaaagcuggaguucgug

SEQ ID NO: 74000 - RNA, 30 nt, Artificial Sequence
  Bifunctional lysine-specific demethylase and histidyl-hydroxylase MINA (93-102)
ggcauguacuaugggagagacgugaacguc

SEQ ID NO: 74001 - RNA, 51 nt, Artificial Sequence
  Heterogeneous nuclear ribonucleoprotein A1-like 2 (126-142)
ggcaacuucgggggaagaagcuccggucccuacggcgggggaggccaguau

SEQ ID NO: 74002 - RNA, 27 nt, Artificial Sequence
  Uncharacterized protein KIAA1841 (80-88)
ggcaacgugaucagcauucugauaucc

SEQ ID NO: 74003 - RNA, 48 nt, Artificial Sequence
  Vimentin (17-32)
ggccccgggaccgccagcagaccuuccucuucaaggaguuacgugaca

SEQ ID NO: 74004 - RNA, 51 nt, Artificial Sequence
  Vimentin (17-33)
ggccccgggaccgccagcagaccuuccucuucaaggaguuacgugacaacu

SEQ ID NO: 74005 - RNA, 42 nt, Artificial Sequence
  Stromal membrane-associated protein 2 (336-349)
ggccaggccgcuaaccaaacccugagcccccagauguggaag

SEQ ID NO: 74006 - RNA, 33 nt, Artificial Sequence
  Integrin beta-3 (297-307)
ggccagugccacguggggagcgacaaccauuac

SEQ ID NO: 74007 - RNA, 30 nt, Artificial Sequence
  Anaphase-promoting complex subunit 7 (149-158)
ggccaggagagacccagcgugaccuccuac

SEQ ID NO: 74008 - RNA, 27 nt, Artificial Sequence
  Protein FAM98A (492-500)
ggccaguucgagcaacacuuucagcau

SEQ ID NO: 74009 - RNA, 30 nt, Artificial Sequence
  UPF0428 protein CXorf56 (123-132)
ggccagggguucggaaagaccaacaucuac

SEQ ID NO: 74010 - RNA, 27 nt, Artificial Sequence
  Melanoma antigen preferentially expressed in tumors (89-97)
ggccagcaccugcaucucgagaccuuc

SEQ ID NO: 74011 - RNA, 27 nt, Artificial Sequence
  Sodium-dependent neutral amino acid transporter B(0)AT2 (281-289)
ggccagaucacccacaacacaagcuuc

SEQ ID NO: 74012 - RNA, 27 nt, Artificial Sequence
  Class E basic helix-loop-helix protein 41 (208-216)
ggccagaagcuggagccccucgccuac

SEQ ID NO: 74013 - RNA, 42 nt, Artificial Sequence
  Heterogeneous nuclear ribonucleoprotein U (692-705)
ggccagaagcccuggagccaacacuaccaucagggguauuac

SEQ ID NO: 74014 - RNA, 27 nt, Artificial Sequence
  CAP-Gly domain-containing linker protein 3 (317-325)
ggccagaagcaagggaucgugagauuc

SEQ ID NO: 74015 - RNA, 30 nt, Artificial Sequence
  Protein SCAI (271-280)
ggccagcugagccucgccgacgcucuuauc

SEQ ID NO: 74016 - RNA, 33 nt, Artificial Sequence
  Ras GTPase-activating protein-binding protein 2 (102-112)
ggccagcccgagagaaaguucaugcaaaccuuu

SEQ ID NO: 74017 - RNA, 27 nt, Artificial Sequence
  Clathrin heavy chain 1 (26-34)
ggccagccccaaccuggguucggauac

SEQ ID NO: 74018 - RNA, 27 nt, Artificial Sequence
  Kinesin-like protein KIF3C (89-97)
ggccagaccgggacaggaaagacuuac

SEQ ID NO: 74019 - RNA, 30 nt, Artificial Sequence; identical to SEQ ID NO: 49792
  F-box only protein 7 (137-146)

SEQ ID NO: 74020 - RNA, 27 nt, Artificial Sequence
  Protein FAM13A (81-89)
ggcagagacaaggggcugaucaacaaa

SEQ ID NO: 74021 - RNA, 57 nt, Artificial Sequence
  Nucleolar and spindle-associated protein 1 (253-271)
ggcagaagcugcgggcccgccucccagucuacccugggacucaaggguucacuuaaa

SEQ ID NO: 74022 - RNA, 27 nt, Artificial Sequence
  Phosphatidylinositide phosphatase SAC2 (738-746)
ggcagcgaccugcccaucauugagaag

SEQ ID NO: 74023 - RNA, 33 nt, Artificial Sequence; identical to SEQ ID NO: 49796
  Anoctamin-4 (845-855)

SEQ ID NO: 74024 - RNA, 42 nt, Artificial Sequence
  Keratin, type II cytoskeletal 1 (603-616)
ggcagcgggggagguuccucuggcgggucaaucggaggcaga

SEQ ID NO: 74025 - RNA, 27 nt, Artificial Sequence
  HLA class I histocompatibility antigen, B-50 alpha chain (25-33)
ggcagccacuccaugagauacuuccau

SEQ ID NO: 74026 - RNA, 27 nt, Artificial Sequence
  LIM and calponin homology domains-containing protein 1 (610-618)
ggcagcaucgagauuaacauaaagaaa

SEQ ID NO: 74027 - RNA, 36 nt, Artificial Sequence
  Poly(rC)-binding protein 1 (26-37)
ggcagcaucauugggaagaaaggagaguccgugaag

SEQ ID NO: 74028 - RNA, 39 nt, Artificial Sequence
  Poly(rC)-binding protein 2 (26-38)
ggcagcaucauugggaagaaaggagaguccgugaagaaa

SEQ ID NO: 74029 - RNA, 27 nt, Artificial Sequence
  Parkinson disease 7 domain-containing protein 1 (55-63)
ggcagccuggccagaauccuccagcac

SEQ ID NO: 74030 - RNA, 27 nt, Artificial Sequence
  Integrator complex subunit 4 (30-38)
ggcagccuggagaaguccgugaccaaa

SEQ ID NO: 74031 - RNA, 30 nt, Artificial Sequence
  Phytanoyl-CoA dioxygenase, peroxisomal (117-126)
ggcagccugaagccccacgacuacccuaaa

SEQ ID NO: 74032 - RNA, 27 nt, Artificial Sequence
  Signal peptidase complex catalytic subunit SEC11A (55-63)
ggcagcauggagcccgccuuccacaga

SEQ ID NO: 74033 - RNA, 27 nt, Artificial Sequence
  ER membrane protein complex subunit 1 (351-359)
ggcagcaugggguccuucucugagaag

SEQ ID NO: 74034 - RNA, 33 nt, Artificial Sequence
  SLAIN motif-containing protein 2 (286-296)
ggcagcaugaaggacgauuccuggaaagacggg

SEQ ID NO: 74035 - RNA, 27 nt, Artificial Sequence
  Dynein heavy chain 14, axonemal (154-162)
ggcagcuccaagaucgccauucagaaa

SEQ ID NO: 74036 - RNA, 33 nt, Artificial Sequence
  Dyslexia-associated protein KIAA0319-like protein (680-690)
ggcagcgugcccaacgggcagaccccucugaag

SEQ ID NO: 74037 - RNA, 39 nt, Artificial Sequence
  28S ribosomal protein S16, mitochondrial (52-64)
ggcagcuacgacccccugccuaacucccacggggagaag

SEQ ID NO: 74038 - RNA, 27 nt, Artificial Sequence
  Transcription factor SOX-10 (199-207)
ggcaccgccgcuauccaggcacacuac

SEQ ID NO: 74039 - RNA, 30 nt, Artificial Sequence
  5,6-dihydroxyindole-2-carboxylic acid oxidase (495-504)
ggcaccgccagcuaccugaucagagcuagg

SEQ ID NO: 74040 - RNA, 24 nt, Artificial Sequence
  FRAS1-related extracellular matrix protein 1 (1422-1429)
ggcaccgacaagcccgaggaacug

SEQ ID NO: 74041 - RNA, 27 nt, Artificial Sequence
  Retinol dehydrogenase 8 (207-215)
ggcaccgaccccgagacacugcacuac

SEQ ID NO: 74042 - RNA, 27 nt, Artificial Sequence
  Receptor-type tyrosine-protein phosphatase gamma isoform X5 (1086-1094)
ggcaccgacuacaucaacgccagcuau

SEQ ID NO: 74043 - RNA, 27 nt, Artificial Sequence
  Fibronectin (331-339)
ggcaccgacuacaagaucuaucuguac

SEQ ID NO: 74044 - RNA, 27 nt, Artificial Sequence
  Myelin proteolipid protein (42-50)
ggcaccgagaagcugaucgaaacauac

SEQ ID NO: 74045 - RNA, 36 nt, Artificial Sequence
  Fructose-bisphosphate aldolase A (48-59)
ggcaccgagaacacagaagagaauagaagguucuac

SEQ ID NO: 74046 - RNA, 36 nt, Artificial Sequence
  Activating signal cointegrator 1 complex subunit 3 (1388-1399)
ggcaccgaguacuaugacgggaagacaagaagguac

SEQ ID NO: 74047 - RNA, 30 nt, Artificial Sequence
  39S ribosomal protein L41, mitochondrial (18-27)
ggcaccuucgaccccgauaaccuggagaag

SEQ ID NO: 74048 - RNA, 36 nt, Artificial Sequence; identical to SEQ ID NO: 49821
  Fibronectin (567-578)

SEQ ID NO: 74049 - RNA, 27 nt, Artificial Sequence
  NHS-like protein 1 (375-383)
ggcaccgggacacugcucagacccaag

SEQ ID NO: 74050 - RNA, 30 nt, Artificial Sequence
  Receptor-interacting serine/threonine-protein kinase 4 (183-192)
ggcaccaucgccuaccugcccccugagaga

SEQ ID NO: 74051 - RNA, 30 nt, Artificial Sequence
  Centromere protein F (3155-3164)
ggcaccauccugagagagcccacaacuaag

SEQ ID NO: 74052 - RNA, 27 nt, Artificial Sequence
  SWI/SNF-related matrix-associated actin-dependent regulator of chromatin subfamily E member 1-related (80-88)
ggcacccuggacuucuacauggccaga

SEQ ID NO: 74053 - RNA, 36 nt, Artificial Sequence
  Translocating chain-associated membrane protein 1 (356-367)
ggcacccugacaagcaacguggccgacucccccaga

SEQ ID NO: 74054 - RNA, 30 nt, Artificial Sequence
  Anaphase-promoting complex subunit 1 (1218-1227)
ggcaccauggacaugagcaucacaagacug

SEQ ID NO: 74055 - RNA, 33 nt, Artificial Sequence
  F-actin-capping protein subunit beta (211-221)
ggcaccaugaaccuggggggaagccucacaaga

SEQ ID NO: 74056 - RNA, 30 nt, Artificial Sequence
  Mitochondrial intermediate peptidase (222-231)
ggcaccaacuuccccaauaagaucgagaaa

SEQ ID NO: 74057 - RNA, 27 nt, Artificial Sequence
  Synaptobrevin homolog YKT6 (178-186)
ggcacccagagcaaggccuucuacaaa

SEQ ID NO: 74058 - RNA, 27 nt, Artificial Sequence
  Protein FAM83D (419-427)
ggcacccagacagccgugaucacuaga

SEQ ID NO: 74059 - RNA, 27 nt, Artificial Sequence
  Neuron navigator 2 (769-777)
ggcacccaggugacacacagcacucug

SEQ ID NO: 74060 - RNA, 27 nt, Artificial Sequence
  MpV17 transgene, murine homolog, glomerulosclerosis, isoform CRA_f (79-87)
ggcaccacaaagguggacgcccugaaa

SEQ ID NO: 74061 - RNA, 30 nt, Artificial Sequence
  Sorcin (118-127)
ggcaccguggacccccaggagcugcaaaag

SEQ ID NO: 74062 - RNA, 36 nt, Artificial Sequence
  Galectin-3 (136-147)
ggcaccgugaagcccaacgccaauagaaucgcucug

SEQ ID NO: 74063 - RNA, 33 nt, Artificial Sequence
  Putative germ cell-less protein-like 1-like (82-92)
ggcaccuacgggcuggacagcgugaagaaaaag

SEQ ID NO: 74064 - RNA, 48 nt, Artificial Sequence
  Chromobox protein homolog 6 (397-412)
ggcguggccggggcugcaggagguggcgggagcaucggagccuccaag

SEQ ID NO: 74065 - RNA, 27 nt, Artificial Sequence
  WD repeat-containing protein 1 (324-332)
ggcguggacgggaacgucagacuguac

SEQ ID NO: 74066 - RNA, 27 nt, Artificial Sequence
  Zinc finger protein 106 (750-758)
ggcguguucgaggggcacaccagcaag

SEQ ID NO: 74067 - RNA, 30 nt, Artificial Sequence
  Scavenger receptor class B member 1 (291-300)
ggcguguucgaggggauccccaccuacaga

SEQ ID NO: 74068 - RNA, 30 nt, Artificial Sequence
  Vacuolar-sorting protein SNF8 (5-14)
ggcgugggggccggagcuaucgcaaagaaa

SEQ ID NO: 74069 - RNA, 42 nt, Artificial Sequence
  Dedicator of cytokinesis protein 4 (591-604)
ggcgugaucgacgccgcugucaacgggggaguuagcagauac

SEQ ID NO: 74070 - RNA, 27 nt, Artificial Sequence
  Ribosomal protein S6 kinase delta-1 (332-340)
ggcgugaucgacaagguccugcucguu

SEQ ID NO: 74071 - RNA, 27 nt, Artificial Sequence
  Disabled homolog 2 (110-118)
ggcgugaucgagcacgaacaucccguc

SEQ ID NO: 74072 - RNA, 33 nt, Artificial Sequence
  Probable ATP-dependent RNA helicase DDX58 (746-756)
ggcgugaucgagaaggaacagauuaacauguac

SEQ ID NO: 74073 - RNA, 33 nt, Artificial Sequence
  Regulator of chromosome condensation (182-192)
ggcgugaucgggcugcucgagcccaugaagaaa

SEQ ID NO: 74074 - RNA, 30 nt, Artificial Sequence
  Interleukin enhancer-binding factor 3 (91-100)
ggcgugaugagagucgggcugguugccaag

SEQ ID NO: 74075 - RNA, 27 nt, Artificial Sequence
  Chromodomain-helicase-DNA-binding protein 4 (1522-1530)
ggcgugaugagccugaucagaaagaaa

SEQ ID NO: 74076 - RNA, 27 nt, Artificial Sequence
  Non-structural maintenance of chromosomes element 1 homolog (3-11)
ggcgugaugaccgacguccacagaagg

SEQ ID NO: 74077 - RNA, 36 nt, Artificial Sequence
  POTE ankyrin domain family member I (75-86)
ggcgugacccacacaguccccaucuacgagggguau

SEQ ID NO: 74078 - RNA, 30 nt, Artificial Sequence
  Protein-glutamine gamma-glutamyltransferase 6 (232-241)
ggcgugguccaggggcaauggcagggaaag

SEQ ID NO: 74079 - RNA, 36 nt, Artificial Sequence
  Copine-3 (78-89)
ggcguguacgacaucgauaacaagaccauugagcug

SEQ ID NO: 74080 - RNA, 30 nt, Artificial Sequence; identical to SEQ ID NO: 49853
  Hyccin (107-116)

SEQ ID NO: 74081 - RNA, 33 nt, Artificial Sequence
  Alpha-actinin-4 (5-15)
cacgccgcuaaccagagcuaccaauauggcccc

SEQ ID NO: 74082 - RNA, 48 nt, Artificial Sequence
  Alpha-actinin-4 (5-20)
cacgccgcuaaccagagcuaccaauauggccccuccucugcagggaau

SEQ ID NO: 74083 - RNA, 27 nt, Artificial Sequence
  Transforming growth factor-beta receptor-associated protein 1 (725-733)
cacgccggccccaccgcucaugagcug

SEQ ID NO: 74084 - RNA, 30 nt, Artificial Sequence
  Leucine-rich repeat-containing protein 1 (515-524)
cacgccaucgacagagugaccacaagcguc

SEQ ID NO: 74085 - RNA, 27 nt, Artificial Sequence
  Coatomer subunit beta (447-455)
cacgccaucaagagcgugaaaauuuac

SEQ ID NO: 74086 - RNA, 27 nt, Artificial Sequence
  G-protein coupled receptor 143 (190-198)
cacgccaucccccauuacgugaccaug

SEQ ID NO: 74087 - RNA, 27 nt, Artificial Sequence
  ATP-dependent RNA helicase DDX3X (209-217)
cacgccauccccauuauaaaggagaaa

SEQ ID NO: 74088 - RNA, 27 nt, Artificial Sequence
  Protein Smaug homolog 2 (682-690)
cacgcccugggcggggagcauuuccuc

SEQ ID NO: 74089 - RNA, 27 nt, Artificial Sequence
  Protein GREB1 (566-574)
cacgccauggacggcgcuagccaucug

SEQ ID NO: 74090 - RNA, 27 nt, Artificial Sequence
  Mothers against decapentaplegic homolog 4 (405-413)
cacgccguguucguccagagcuacuau

SEQ ID NO: 74091 - RNA, 27 nt, Artificial Sequence
  U4/U6.U5 tri-snRNP-associated protein 2 (151-159)
cacgccuacauccauagcgugcaguuc

SEQ ID NO: 74092 - RNA, 27 nt, Artificial Sequence
  Helicase SRCAP (102-110)
cacgaggccgaaaucgagaccagaauu

SEQ ID NO: 74093 - RNA, 30 nt, Artificial Sequence
  Zinc finger FYVE domain-containing protein 16 (414-423)
cacgaggaaauccagaacagcgugguccug

SEQ ID NO: 74094 - RNA, 45 nt, Artificial Sequence
  Phospholipid hydroperoxide glutathione peroxidase, mitochondrial (42-56)
cacgaguucagcgccaaggacaucgauggccauauggugaaccug

SEQ ID NO: 74095 - RNA, 30 nt, Artificial Sequence
  Activin receptor type-1B isoform X3 (285-294)
cacgagcauggcagccuguucgacuaccuc

SEQ ID NO: 74096 - RNA, 27 nt, Artificial Sequence
  Sex comb on midleg-like protein 4 (131-139)
cacgagaucgacggcaacgcccugcuc

SEQ ID NO: 74097 - RNA, 39 nt, Artificial Sequence
  Insulin-like growth factor-binding protein 7 (270-282)
cacgagauccccgugaagaaaggcgaaggggccgagcug

SEQ ID NO: 74098 - RNA, 27 nt, Artificial Sequence
  Major facilitator superfamily domain-containing protein 12 (161-169)
cacgagaagguggaacugaccgcccuc

SEQ ID NO: 74099 - RNA, 30 nt, Artificial Sequence
  Putative RNA-binding protein Luc7-like 1 (110-119)
cacgagcugaacgaagagaucggcaagcuc

SEQ ID NO: 74100 - RNA, 27 nt, Artificial Sequence
  Alpha-parvin (245-253)
cacgagagagacgccuucgauacccug

SEQ ID NO: 74101 - RNA, 24 nt, Artificial Sequence
  Monocarboxylate transporter 5 (168-175)
cacgagaccgaagagagcacaauc

SEQ ID NO: 74102 - RNA, 30 nt, Artificial Sequence
  Cadherin-19 (309-318)
cacgagacccaggaaggcaucgugauucug

SEQ ID NO: 74103 - RNA, 30 nt, Artificial Sequence
  Liprin-alpha-1 (69-78)
cacgaggugggccaugaaagagacagccug

SEQ ID NO: 74104 - RNA, 30 nt, Artificial Sequence
  60S ribosomal protein L36a-like (90-99)
cacuucgagcugggcggggacaagaaaaga

SEQ ID NO: 74105 - RNA, 36 nt, Artificial Sequence
  60S ribosomal protein L36a-like (90-101)
cacuucgagcugggcggggacaagaaaagaaaggga

SEQ ID NO: 74106 - RNA, 39 nt, Artificial Sequence
  60S ribosomal protein L36a-like (90-102)
cacuucgagcugggcggggacaagaaaagaaagggacag

SEQ ID NO: 74107 - RNA, 51 nt, Artificial Sequence
  60S ribosomal protein L36a-like (90-106)
cacuucgagcugggcggggacaagaaaagaaagggacaggugauccaauuu

SEQ ID NO: 74108 - RNA, 39 nt, Artificial Sequence
  Interleukin enhancer-binding factor 3 (666-678)
cacggcggguacaugaacgccggagcugguuauggcagc

SEQ ID NO: 74109 - RNA, 27 nt, Artificial Sequence
  Tubulin beta-2A chain (21-29)
cacggcaucgaccccaccgggagcuac

SEQ ID NO: 74110 - RNA, 39 nt, Artificial Sequence
  Dyslexia-associated protein KIAA0319-like protein (676-688)
cacggccagaacgggagcgugcccaauggacaaaccccu

SEQ ID NO: 74111 - RNA, 30 nt, Artificial Sequence
  Putative heat shock protein HSP 90-beta-3 (6-15)
caccauggcgaggaagagguggaaaccuuc

SEQ ID NO: 74112 - RNA, 48 nt, Artificial Sequence
  G protein-coupled receptor kinase 5 (575-590)
caccauaucaacagcaaucacguguccucuaacucaaccggcaguagc

SEQ ID NO: 74113 - RNA, 51 nt, Artificial Sequence
  Non-POU domain-containing octamer-binding protein (28-44)
caccaucagcaacagcagcagcaacccccuccaccgcccaucccugccaac

SEQ ID NO: 74114 - RNA, 27 nt, Artificial Sequence
  F-box/WD repeat-containing protein 11 (32-40)
cacaucgccgagaacauucugagcuac

SEQ ID NO: 74115 - RNA, 27 nt, Artificial Sequence
  60S ribosomal protein L8 (172-180)
cacaucggcaagcccagcaccauuaga

SEQ ID NO: 74116 - RNA, 27 nt, Artificial Sequence
  Retinol dehydrogenase 14 (257-265)
cacauccauauuccccugcucgugaag

SEQ ID NO: 74117 - RNA, 27 nt, Artificial Sequence
  HMG box-containing protein 1 (138-146)
cacaucauugccaccagcaagucccug

SEQ ID NO: 74118 - RNA, 30 nt, Artificial Sequence
  NADH-ubiquinone oxidoreductase chain 5 (394-403)
cacaucauugagaccgccaacaugagcuac

SEQ ID NO: 74119 - RNA, 27 nt, Artificial Sequence
  UBX domain-containing protein 2A (198-206)
cacaucaaggacuucauugagaaauac

SEQ ID NO: 74120 - RNA, 30 nt, Artificial Sequence
  Tyrosine-protein kinase JAK1 (584-593)
cacaucuacagcggcacccugauggacuau

SEQ ID NO: 74121 - RNA, 30 nt, Artificial Sequence
  Disintegrin and metalloproteinase domain-containing protein 10 (101-110)
cacaucuacaccggccauauuuaugacuac

SEQ ID NO: 74122 - RNA, 27 nt, Artificial Sequence
  Cyclin-L2 (129-137)
caccuggccagcaagaucgaggaagcu

SEQ ID NO: 74123 - RNA, 27 nt, Artificial Sequence
  Nesprin-1 (1108-1116)
caccuggacgaggaucagcaagaacuc

SEQ ID NO: 74124 - RNA, 21 nt, Artificial Sequence
  UDP-N-acetylglucosamine-dolichyl-phosphate N-acetylglucosaminephosphotransferase (55-61)
caccuggaccucggcauccuu

SEQ ID NO: 74125 - RNA, 24 nt, Artificial Sequence
  UDP-N-acetylglucosamine-dolichyl-phosphate N-acetylglucosaminephosphotransferase (55-62)
caccuggaccucggcauccuuuac

SEQ ID NO: 74126 - RNA, 24 nt, Artificial Sequence
  Histone H3-like centromeric protein A (104-111)
caccuguucgaggacgccuaccuc

SEQ ID NO: 74127 - RNA, 27 nt, Artificial Sequence
  Histone H3-like centromeric protein A (104-112)
caccuguucgaggacgccuaccuccuu

SEQ ID NO: 74128 - RNA, 30 nt, Artificial Sequence
  WD repeat-containing protein 43 (142-151)
caccuguucgagcauauccucaacggcuac

SEQ ID NO: 74129 - RNA, 27 nt, Artificial Sequence
  UPF0536 protein C12orf66 (239-247)
caccuguucggcgggcagagccaaaag

SEQ ID NO: 74130 - RNA, 30 nt, Artificial Sequence
  Protein Shroom4 (1371-1380)
caccuguucgugggcgaccucgauaagguc

SEQ ID NO: 74131 - RNA, 30 nt, Artificial Sequence; identical to SEQ ID NO: 49904
  cDNA FLJ60317, highly similar to Aminoacylase-1 (EC 3.5.1.14) (332-341)

SEQ ID NO: 74132 - RNA, 33 nt, Artificial Sequence
  Homeodomain-interacting protein kinase 2 (531-541)
caccugcucgacuucccccauagcacccacgug

SEQ ID NO: 74133 - RNA, 27 nt, Artificial Sequence
  Pre-mRNA-processing-splicing factor 8 (1875-1883)
caccugcucgacuuccccaacaucgug

SEQ ID NO: 74134 - RNA, 33 nt, Artificial Sequence
  Adenylosuccinate lyase (442-452)
caccugcucgaccccagcuccuucaccggcaga

SEQ ID NO: 74135 - RNA, 33 nt, Artificial Sequence
  Mitotic checkpoint serine/threonine-protein kinase BUB1 (791-801)
caccugcucggcgagggggccuucgcucaggug

SEQ ID NO: 74136 - RNA, 27 nt, Artificial Sequence
  Superkiller viralicidic activity 2-like 2 (735-743)
caccugcucagcgccaucuccucugug

SEQ ID NO: 74137 - RNA, 27 nt, Artificial Sequence
  Glutamine synthetase (8-16)
caccugaacaagggcaucaaacaggug

SEQ ID NO: 74138 - RNA, 27 nt, Artificial Sequence
  Integrator complex subunit 11 (516-524)
caccugcccgacggcagcgugaccguc

SEQ ID NO: 74139 - RNA, 27 nt, Artificial Sequence
  Putative ATP-dependent RNA helicase TDRD12 (984-992)
caccugcccgagcauuuccacacccuc

SEQ ID NO: 74140 - RNA, 27 nt, Artificial Sequence
  Unconventional myosin-Id (220-228)
caccugcagaagagccucuccucuuac

SEQ ID NO: 74141 - RNA, 27 nt, Artificial Sequence
  Testis-expressed sequence 10 protein (95-103)
caccugagcaacauccucuccgaggug

SEQ ID NO: 74142 - RNA, 27 nt, Artificial Sequence
  NADH-ubiquinone oxidoreductase chain 4 (83-91)
caccugagcuccgagccccucucuaga

SEQ ID NO: 74143 - RNA, 27 nt, Artificial Sequence
  RAD50-interacting protein 1 (429-437)
caccugguggacgagguccuccuuuuc

SEQ ID NO: 74144 - RNA, 27 nt, Artificial Sequence
  Thiamin pyrophosphokinase 1 (34-42)
caccuguggaacaaggcccuccuuaga

SEQ ID NO: 74145 - RNA, 30 nt, Artificial Sequence
  Proline-rich nuclear receptor coactivator 1 (204-213)
caccuguacgagcagcccaagaucaacaga

SEQ ID NO: 74146 - RNA, 27 nt, Artificial Sequence
  60S ribosomal protein L19 (99-107)
cacauguaccauagccuguaucucaag

SEQ ID NO: 74147 - RNA, 27 nt, Artificial Sequence
  COP9 signalosome complex subunit 8 (47-55)
cacaacgacaugaauaacgccagauac

SEQ ID NO: 74148 - RNA, 36 nt, Artificial Sequence
  Probable ATP-dependent RNA helicase DDX5 (585-596)
cacaacggcaugaaucagcaagccuacgcuuauccc

SEQ ID NO: 74149 - RNA, 24 nt, Artificial Sequence
  Ankycorbin (931-938)
caccaggaggugaucagcgucuac

SEQ ID NO: 74150 - RNA, 42 nt, Artificial Sequence
  Protein FAM98A (489-502)
caccagggcgggcaauucgagcagcauuuucagcacggaggu

SEQ ID NO: 74151 - RNA, 24 nt, Artificial Sequence
  WD repeat-containing protein 70 (230-237)
caccagaucaagagccugcaauac

SEQ ID NO: 74152 - RNA, 30 nt, Artificial Sequence
  Sulfotransferase 1C2 (198-207)
caccagauccuguuccucuuuuacgaggac

SEQ ID NO: 74153 - RNA, 33 nt, Artificial Sequence
  Melanocyte protein PMEL (562-572)
caccagauccugaagggcgggagcggaaccuac

SEQ ID NO: 74154 - RNA, 24 nt, Artificial Sequence
  Kinesin-1 heavy chain (712-719)
caccagaagcaaaucagcucccug

SEQ ID NO: 74155 - RNA, 27 nt, Artificial Sequence
  Zinc finger SWIM domain-containing protein 3 (499-507)
caccagagcggcuccgagcuggccuac

SEQ ID NO: 74156 - RNA, 30 nt, Artificial Sequence
  Catenin delta-2 (274-283)
cacagacccccugccagcgaguacaccaug

SEQ ID NO: 74157 - RNA, 39 nt, Artificial Sequence
  RNMT-activating mini protein (94-106)
cacagacaggagcccuacuauccucaacaguacggccau

SEQ ID NO: 74158 - RNA, 27 nt, Artificial Sequence
  Biorientation of chromosomes in cell division protein 1-like 1 (75-83)
cacagcgcccugcccaaccagucccuc

SEQ ID NO: 74159 - RNA, 30 nt, Artificial Sequence
  Monoacylglycerol lipase ABHD12 (365-374)
cacagcgaccugggcuacagacauaaguau

SEQ ID NO: 74160 - RNA, 33 nt, Artificial Sequence
  Transient receptor potential cation channel subfamily A member 1 (758-768)
cacagcgagauccuggacaccacaaacuccuac

SEQ ID NO: 74161 - RNA, 27 nt, Artificial Sequence
  Alstrom syndrome protein 1 (958-966)
cacagcgagaaguccucuguguucuac

SEQ ID NO: 74162 - RNA, 27 nt, Artificial Sequence
  Glycine dehydrogenase (decarboxylating), mitochondrial (529-537)
cacagcgagaccaacaucgugagauac

SEQ ID NO: 74163 - RNA, 30 nt, Artificial Sequence
  Dedicator of cytokinesis protein 9 (1147-1156)
cacagcuucgacgauagauacgccuccagg

SEQ ID NO: 74164 - RNA, 33 nt, Artificial Sequence
  Tubulin alpha-3C/D chain (138-148)
cacagcuucggcgggggaaccgguuccggcuuu

SEQ ID NO: 74165 - RNA, 36 nt, Artificial Sequence
  Tubulin alpha-1C chain (104-115)
cacagcuucggcgggggaaccgguuccggcuuuaca

SEQ ID NO: 74166 - RNA, 24 nt, Artificial Sequence
  E3 ubiquitin-protein ligase TRIM33 (605-612)
cacagcggcccccaguacuccaug

SEQ ID NO: 74167 - RNA, 42 nt, Artificial Sequence
  Tubulin gamma-1 chain (139-152)
cacagcaucgccggcgggaccggauccggucugggcucuuac

SEQ ID NO: 74168 - RNA, 36 nt, Artificial Sequence
  Macrophage migration inhibitory factor (61-72)
cacagcaucggcaagauugggggagcccagaacaga

SEQ ID NO: 74169 - RNA, 33 nt, Artificial Sequence
  Rho-related BTB domain-containing protein 3 (176-186)
cacagccuggacgauuucuacaucggcaaguau

SEQ ID NO: 74170 - RNA, 33 nt, Artificial Sequence
  Copper transport protein ATOX1 (46-56)
cacagcauggacacccugcucgccacacuuaag

SEQ ID NO: 74171 - RNA, 24 nt, Artificial Sequence
  40S ribosomal protein S20 (92-99)
cacagccccuccgagaucgugaag

SEQ ID NO: 74172 - RNA, 36 nt, Artificial Sequence
  Transcriptional regulator Kaiso (573-584)
cacagccaggaccccuccggcgauucuaagcuguac

SEQ ID NO: 74173 - RNA, 30 nt, Artificial Sequence
  FERM domain-containing protein 4A (823-832)
cacagccagucccaacccucuucacaguac

SEQ ID NO: 74174 - RNA, 27 nt, Artificial Sequence
  Nipped-B-like protein (134-142)
cacagcucccccgccucuucaaacuac

SEQ ID NO: 74175 - RNA, 30 nt, Artificial Sequence
  Melanocyte protein PMEL (639-648)
cacagcuccucucauuggcugagacucccc

SEQ ID NO: 74176 - RNA, 27 nt, Artificial Sequence
  Transformation/transcription domain-associated protein (3009-3017)
cacagcuccucuaucgugaccgccuac

SEQ ID NO: 74177 - RNA, 33 nt, Artificial Sequence
  PERQ amino acid-rich with GYF domain-containing protein 2 (1230-1240)
cacagcacccugcauuccguguuccagacaaac

SEQ ID NO: 74178 - RNA, 45 nt, Artificial Sequence
  PERQ amino acid-rich with GYF domain-containing protein 2 (1230-1244)
cacagcacccugcauuccguguuccagacaaaccaaucuaauaac

SEQ ID NO: 74179 - RNA, 27 nt, Artificial Sequence
  Ribosome maturation protein SBDS (54-62)
cacagcguguucgucaacguuuccaag

SEQ ID NO: 74180 - RNA, 24 nt, Artificial Sequence
  Proteasome assembly chaperone 2 (85-92)
cacagcuaccagagaaacgaccug

SEQ ID NO: 74181 - RNA, 27 nt, Artificial Sequence
  Adenine DNAosylase (479-487)
cacaccgccgcugugagcacagcaaug

SEQ ID NO: 74182 - RNA, 27 nt, Artificial Sequence
  Protein archease (38-46)
cacaccgccgacgugcauggccuguac

SEQ ID NO: 74183 - RNA, 30 nt, Artificial Sequence
  Protein archease (38-47)
cacaccgccgacgugcauggccuguacuau

SEQ ID NO: 74184 - RNA, 30 nt, Artificial Sequence
  Protein O-linked-mannose beta-1,2-N-acetylglucosaminyltransferase 1 (410-419)
cacaccgccgaggaccccgcucugcucuac

SEQ ID NO: 74185 - RNA, 27 nt, Artificial Sequence
  Proton myo-inositol cotransporter (546-554)
cacaccgccgaguaccugacauauuac

SEQ ID NO: 74186 - RNA, 27 nt, Artificial Sequence
  Hydroxyacylglutathione hydrolase-like protein (110-118)
cacaccgccggccauaugagcuacuuc

SEQ ID NO: 74187 - RNA, 27 nt, Artificial Sequence
  Tensin-1 (628-636)
cacaccgcccccaugagaccuagcuac

SEQ ID NO: 74188 - RNA, 27 nt, Artificial Sequence
  CD63 antigen (131-139)
cacaccgccagcauccuggacagaaug

SEQ ID NO: 74189 - RNA, 27 nt, Artificial Sequence
  Alanine-tRNA ligase, cytoplasmic (605-613)
cacaccgccacacauauccugaacuuc

SEQ ID NO: 74190 - RNA, 24 nt, Artificial Sequence
  U3 small nucleolar RNA-associated protein 6 homolog (267-274)
cacaccgacgauccccugacaugg

SEQ ID NO: 74191 - RNA, 24 nt, Artificial Sequence
  Mitochondrial enolase superfamily member 1 (29-36)
cacaccgaccccgauuacagcgcc

SEQ ID NO: 74192 - RNA, 30 nt, Artificial Sequence
  Ras GTPase-activating protein 3 (501-510)
cacaccgacccccagacaagcagaacucug

SEQ ID NO: 74193 - RNA, 30 nt, Artificial Sequence
  Zinc finger protein DZIP1 (221-230)
cacaccgaggaaaacagccauuucgaguac

SEQ ID NO: 74194 - RNA, 27 nt, Artificial Sequence
  Protein FAM214A (1013-1021)
cacaccgaggaaagacugcucagguac

SEQ ID NO: 74195 - RNA, 36 nt, Artificial Sequence
  Melanophilin (469-480)
cacaccuucgccaagcccguggucgcucaucagagc

SEQ ID NO: 74196 - RNA, 33 nt, Artificial Sequence
  Cytochrome c oxidase subunit 1 (503-513)
cacaccuucgaggaacccguguacaugaagagc

SEQ ID NO: 74197 - RNA, 39 nt, Artificial Sequence
  Protein tyrosine phosphatase type IVA 1 (21-33)
cacaccuucauggaguuucugaagggcagcggggacuac

SEQ ID NO: 74198 - RNA, 30 nt, Artificial Sequence
  GRB2-associated-binding protein 2 (554-563)
cacaccuucaacagcuccucuucacaguac

SEQ ID NO: 74199 - RNA, 27 nt, Artificial Sequence
  Discoidin, CUB and LCCL domain-containing protein 1 (613-621)
cacaccuucagcgcccaguccggcuac

SEQ ID NO: 74200 - RNA, 27 nt, Artificial Sequence
  Importin-8 (408-416)
cacaccaucgacacaauucugacugug

SEQ ID NO: 74201 - RNA, 33 nt, Artificial Sequence
  Protein pelota homolog (100-110)
cacaccaucgagcuggaacccaacagacaguuc

SEQ ID NO: 74202 - RNA, 27 nt, Artificial Sequence
  Tubulin polyglutamylase TTLL5 (968-976)
cacaccaucggccccuucagcuccuuu

SEQ ID NO: 74203 - RNA, 30 nt, Artificial Sequence
  Nuclear pore complex protein Nup107 (862-871)
cacaccauccugcauagcacaggccaguac

SEQ ID NO: 74204 - RNA, 30 nt, Artificial Sequence; identical to SEQ ID NO: 49977
  S-methyl-5'-thioadenosine phosphorylase (65-74)

SEQ ID NO: 74205 - RNA, 27 nt, Artificial Sequence
  Serologically defined colon cancer antigen 8 (120-128)
cacaccaucaacgaccagagccaauac

SEQ ID NO: 74206 - RNA, 27 nt, Artificial Sequence
  Minor histocompatibility antigen H13 (119-127)
cacaccaucagccccuucaugaacaag

SEQ ID NO: 74207 - RNA, 42 nt, Artificial Sequence
  Tyrosinase (143-156)
cacaccaucagcuccgacuacgugauucccauaggcacauau

SEQ ID NO: 74208 - RNA, 27 nt, Artificial Sequence
  Cytoskeleton-associated protein 2 (499-507)
cacaccaucguggacauucugacaaug

SEQ ID NO: 74209 - RNA, 30 nt, Artificial Sequence
  Cytoplasmic protein NCK2 (351-360)
cacaccauggacgagcugguggaacauuac

SEQ ID NO: 74210 - RNA, 36 nt, Artificial Sequence
  U3 small nucleolar RNA-associated protein 18 homolog (362-373)
cacaccauggacuucagccccagauccggcuacuuu

SEQ ID NO: 74211 - RNA, 33 nt, Artificial Sequence; identical to SEQ ID NO: 49984
  Queuine tRNA-ribosyltransferase subunit QTRTD1 (26-36)

SEQ ID NO: 74212 - RNA, 27 nt, Artificial Sequence
  Syntaxin-18 (80-88)
cacaccaugagcgaguacggcagaaug

SEQ ID NO: 74213 - RNA, 30 nt, Artificial Sequence
  Histone-lysine N-methyltransferase setd3 (279-288)
cacaccaacggccugaucacaacuggguac

SEQ ID NO: 74214 - RNA, 33 nt, Artificial Sequence
  Alpha-adducin (241-251)
cacacccccgccggcgcugcagugagcgccaug

SEQ ID NO: 74215 - RNA, 30 nt, Artificial Sequence
  Alpha-1,6-mannosylglycoprotein 6-beta-N-acetylglucosaminyltransferase B (424-433)
cacacccccgacaacagcuucaugggcuuu

SEQ ID NO: 74216 - RNA, 30 nt, Artificial Sequence
  Lanosterol 14-alpha demethylase (489-498)
cacacccccgagaacccugugaucagauac

SEQ ID NO: 74217 - RNA, 33 nt, Artificial Sequence
  Iroquois-class homeodomain protein IRX-5 (89-99)
cacacccccggcauggccgggagccugggauac

SEQ ID NO: 74218 - RNA, 27 nt, Artificial Sequence
  Ligand of Numb protein X 2 (443-451)
cacacccccccuccauacuauagcaga

SEQ ID NO: 74219 - RNA, 33 nt, Artificial Sequence; identical to SEQ ID NO: 49992
  Tensin-1 (410-420)

SEQ ID NO: 74220 - RNA, 30 nt, Artificial Sequence
  Succinate dehydrogenase (ubiquinone) flavoprotein subunit, mitochondrial (270-279)
cacaccagcacaggcgacgggacugccaug

SEQ ID NO: 74221 - RNA, 27 nt, Artificial Sequence
  Very-long-chain (3R)-3-hydroxyacyl-CoA dehydratase 3 (185-193)
cacaccguggccgacaugauguacuuc

SEQ ID NO: 74222 - RNA, 27 nt, Artificial Sequence
  Tetratricopeptide repeat protein 38 (218-226)
cacaccguggcccauauccacgagaug

SEQ ID NO: 74223 - RNA, 30 nt, Artificial Sequence
  U3 small nucleolar RNA-associated protein 15 homolog (126-135)
cacaccguggacuucacagccgauaaguac

SEQ ID NO: 74224 - RNA, 33 nt, Artificial Sequence
  Aprataxin (170-180)
cacaccgugggcgagaaggucaucguugacuuc

SEQ ID NO: 74225 - RNA, 30 nt, Artificial Sequence
  Sodium-dependent phosphate transporter 1 (379-388)
cacaccgugcauaaggacagcggccuguac

SEQ ID NO: 74226 - RNA, 30 nt, Artificial Sequence
  Heterogeneous nuclear ribonucleoprotein A1-like 2 (15-24)
cacaccgugaacggccauaauugcgagguc

SEQ ID NO: 74227 - RNA, 36 nt, Artificial Sequence
  Melanocyte protein PMEL (285-296)
cacaccuaccuggagcccggcccugugacagcccag

SEQ ID NO: 74228 - RNA, 30 nt, Artificial Sequence
  Oxidoreductase-like domain-containing protein 1 (115-124)
cacguggccgacgagaaccugaaggcuuuc

SEQ ID NO: 74229 - RNA, 30 nt, Artificial Sequence
  Condensin complex subunit 2 (196-205)
cacguggccgacggcagcgcuaccgagaug

SEQ ID NO: 74230 - RNA, 30 nt, Artificial Sequence
  1-phosphatidylinositol 4,5-bisphosphate phosphodiesterase beta-4 (428-437)
cacguggccgaggaaagaaacauccauuac

SEQ ID NO: 74231 - RNA, 30 nt, Artificial Sequence
  Protein FAN (292-301)
cacguggccgagcauaccgcugaaagcuac

SEQ ID NO: 74232 - RNA, 27 nt, Artificial Sequence
  GPI-anchor transamidase (62-70)
cacguggccaacacccugagcgucuac

SEQ ID NO: 74233 - RNA, 30 nt, Artificial Sequence; identical to SEQ ID NO: 50006
  RNA polymerase-associated protein CTR9 homolog (745-754)

SEQ ID NO: 74234 - RNA, 33 nt, Artificial Sequence; identical to SEQ ID NO: 50007
  RNA polymerase-associated protein CTR9 homolog (745-755)

SEQ ID NO: 74235 - RNA, 27 nt, Artificial Sequence
  40S ribosomal protein S16 (76-84)
cacguggcccagaucuacgcuauuaga

SEQ ID NO: 74236 - RNA, 27 nt, Artificial Sequence
  F-box only protein 31 (181-189)
cacguggacgaucccaugagauucaag

SEQ ID NO: 74237 - RNA, 27 nt, Artificial Sequence
  tRNA wybutosine-synthesizing protein 2 homolog (192-200)
cacguggacaacggcaucagauacaag

SEQ ID NO: 74238 - RNA, 24 nt, Artificial Sequence
  P protein (222-229)
cacguggacagcacccugcuccag

SEQ ID NO: 74239 - RNA, 27 nt, Artificial Sequence
  P protein (222-230)
cacguggacagcacccugcuccagguc

SEQ ID NO: 74240 - RNA, 30 nt, Artificial Sequence
  PRELI domain containing protein 3B (8-17)
cacguguucgaccaucccugggagaccguc

SEQ ID NO: 74241 - RNA, 30 nt, Artificial Sequence
  RNA polymerase II subunit A C-terminal domain phosphatase (243-252)
cacguguucaccuuuggcagcagacuguac

SEQ ID NO: 74242 - RNA, 27 nt, Artificial Sequence
  Neuropilin-2 (221-229)
cacgugggcccccugaucgggaaguac

SEQ ID NO: 74243 - RNA, 27 nt, Artificial Sequence
  Filamin-A (138-146)
cacgugggcagcagacuguacuccguc

SEQ ID NO: 74244 - RNA, 27 nt, Artificial Sequence
  Endoribonuclease Dicer (1769-1777)
cacgugaucgacgauuucguccaguuu

SEQ ID NO: 74245 - RNA, 33 nt, Artificial Sequence
  TRAF2 and NCK-interacting protein kinase (370-380)
cacgugaucgacgucgauagcggcaacuccuac

SEQ ID NO: 74246 - RNA, 33 nt, Artificial Sequence
  Activity-dependent neuroprotector homeobox protein (210-220)
cacgugaucgaggaccaugaaagaauuggcuac

SEQ ID NO: 74247 - RNA, 27 nt, Artificial Sequence
  Interferon-induced helicase C domain-containing protein 1 (921-929)
cacgugaucgagaagaugcaucacguc

SEQ ID NO: 74248 - RNA, 33 nt, Artificial Sequence
  Cytochrome b-c1 complex subunit 2, mitochondrial (172-182)
cacgugaucgagaaccugcaugccgcugcauac

SEQ ID NO: 74249 - RNA, 27 nt, Artificial Sequence
  Myomegalin (2179-2187)
cacgugaucggccauauugacgauuac

SEQ ID NO: 74250 - RNA, 33 nt, Artificial Sequence
  Protein bicaudal C homolog 1 (746-756)
cacgugaucggcaaggggggaaacaauauuaaa

SEQ ID NO: 74251 - RNA, 30 nt, Artificial Sequence; identical to SEQ ID NO: 50024
  116 kDa U5 small nuclear ribonucleoprotein component (627-636)

SEQ ID NO: 74252 - RNA, 30 nt, Artificial Sequence; identical to SEQ ID NO: 50025
  Voltage-gated potassium channel subunit beta-1 (216-225)

SEQ ID NO: 74253 - RNA, 27 nt, Artificial Sequence
  Regulator of telomere elongation helicase 1 (740-748)
cacgugaucagagacgucgcccaguuc

SEQ ID NO: 74254 - RNA, 30 nt, Artificial Sequence
  BTB/POZ domain-containing protein KCTD1 (197-206)
cacgugaucagauucccccugaacggcuac

SEQ ID NO: 74255 - RNA, 36 nt, Artificial Sequence
  DNA-directed RNA polymerase II subunit RPB1 (1384-1395)
cacgugaucagcuucgacggcuccuacgucaacuau

SEQ ID NO: 74256 - RNA, 30 nt, Artificial Sequence
  Disco-interacting protein 2 homolog C (561-570)
cacgugaucagcauucccuacucccugaug

SEQ ID NO: 74257 - RNA, 27 nt, Artificial Sequence
  E3 SUMO-protein ligase RanBP2 (2985-2993)
cacgugaucaccaagacaauggagcug

SEQ ID NO: 74258 - RNA, 30 nt, Artificial Sequence
  40S ribosomal protein S4, Y isoform 1 (208-217)
cacgugaaggacgccaacggcaauagcuuc

SEQ ID NO: 74259 - RNA, 30 nt, Artificial Sequence
  Nodal modulator 3 (252-261)
cacgugcugggcaccaucacaacugacaag

SEQ ID NO: 74260 - RNA, 30 nt, Artificial Sequence
  Pecanex-like protein 1 (113-122)
cacgugauggacgauggcaccaacgaguac

SEQ ID NO: 74261 - RNA, 30 nt, Artificial Sequence
  Pleckstrin homology domain-containing family G member 3 (497-506)
cacgugauggacagccaugucuccgagaga

SEQ ID NO: 74262 - RNA, 33 nt, Artificial Sequence
  Elongation factor G, mitochondrial (445-455)
cacgugcccgacccugucaucagcauugccaug

SEQ ID NO: 74263 - RNA, 27 nt, Artificial Sequence
  Probable phospholipid-transporting ATPase IIB (501-509)
cacgugagagacagcuacucccagaug

SEQ ID NO: 74264 - RNA, 27 nt, Artificial Sequence
  Sideroflexin-1 (171-179)
cacgugagcccccugaucggcagauuc

SEQ ID NO: 74265 - RNA, 27 nt, Artificial Sequence
  Long-chain-fatty-acid-CoA ligase 3 (4-12)
cacgugagcuccaagcccucuaccaug

SEQ ID NO: 74266 - RNA, 33 nt, Artificial Sequence
  Zinc finger protein 451 (549-559)
cacgugaccgaguuccauaacggccacagauac

SEQ ID NO: 74267 - RNA, 27 nt, Artificial Sequence
  Deoxyribose-phosphate aldolase (322-330)
cacgugaccggcagauacgccgcuuau

SEQ ID NO: 74268 - RNA, 27 nt, Artificial Sequence
  Phosphoribosylformylglycinamidine synthase (342-350)
cacguggucgccggcaccgcuggguac

SEQ ID NO: 74269 - RNA, 30 nt, Artificial Sequence
  Jouberin (369-378)
cacguggucgacgagcauaccggccaguac

SEQ ID NO: 74270 - RNA, 27 nt, Artificial Sequence
  Nephrocystin-4 (1128-1136)
cacguggucgaccagguuuucagauuu

SEQ ID NO: 74271 - RNA, 33 nt, Artificial Sequence
  Tetratricopeptide repeat protein 39B (542-552)
cacguggucgagagcgaaaagcugcucaaauac

SEQ ID NO: 74272 - RNA, 30 nt, Artificial Sequence
  Dedicator of cytokinesis protein 10 (121-130)
cacguggucaacuacaaguaugagcaguac

SEQ ID NO: 74273 - RNA, 27 nt, Artificial Sequence
  Large proline-rich protein BAG6 (350-358)
cacguggucagacccaugagccauuac

SEQ ID NO: 74274 - RNA, 27 nt, Artificial Sequence
  HEAT repeat-containing protein 5A (373-381)
cacguggucagcuccguuucuucauuc

SEQ ID NO: 74275 - RNA, 36 nt, Artificial Sequence
  WD repeat-containing protein 74 (10-21)
cacgugugggucggcaccgagacagggauccugaag

SEQ ID NO: 74276 - RNA, 33 nt, Artificial Sequence
  Vesicle-associated membrane protein 7 (159-169)
cacguguacgaggaaccccaggcccauuauuac

SEQ ID NO: 74277 - RNA, 30 nt, Artificial Sequence
  Regulator of chromosome condensation (291-300)
cacguguacggcuucgggcugagcaacuau

SEQ ID NO: 74278 - RNA, 27 nt, Artificial Sequence
  Transmembrane protein 209 (513-521)
cacguguacaaccugcccaagggcaga

SEQ ID NO: 74279 - RNA, 30 nt, Artificial Sequence
  Bcl-2 homologous antagonist/killer (141-150)
cacguguaccagcauggccugaccggguuc

SEQ ID NO: 74280 - RNA, 27 nt, Artificial Sequence
  Little elongation complex subunit 1 (1936-1944)
cacguguacgucggcaacaucagcaag

SEQ ID NO: 74281 - RNA, 30 nt, Artificial Sequence
  Neutral amino acid transporter B(0) (523-532)
cacuacagaggccccgccggggacgcuacc

SEQ ID NO: 74282 - RNA, 30 nt, Artificial Sequence
  UPF0568 protein C14orf166 (230-239)
aucgccgaccccaagaccgaucacagacug

SEQ ID NO: 74283 - RNA, 27 nt, Artificial Sequence
  Endoplasmin (212-220)
aucgccgaccccagaggcaacacccug

SEQ ID NO: 74284 - RNA, 36 nt, Artificial Sequence
  40S ribosomal protein S19 (134-145)
aucgccggccagguggcugcagccaacaagaaacac

SEQ ID NO: 74285 - RNA, 27 nt, Artificial Sequence
  Tensin-1 (1325-1333)
aucgccagccccggcuccccuucucug

SEQ ID NO: 74286 - RNA, 27 nt, Artificial Sequence
  Hemicentin-1 (4090-4098)
aucgccguggacaagcccauuacccug

SEQ ID NO: 74287 - RNA, 27 nt, Artificial Sequence
  Uncharacterized protein KIAA1210 (412-420)
aucgccguggagagagucauuagcguu

SEQ ID NO: 74288 - RNA, 27 nt, Artificial Sequence
  Protein SDE2 homolog (286-294)
aucgacaaggagaccauugaucugcuc

SEQ ID NO: 74289 - RNA, 39 nt, Artificial Sequence
  Syndecan-3 (293-305)
aucgacagcggcuccucugccgcucagcugccccaaaag

SEQ ID NO: 74290 - RNA, 30 nt, Artificial Sequence
  Cullin-3 (721-730)
aucgagggccugauugaaagagaguaccuc

SEQ ID NO: 74291 - RNA, 24 nt, Artificial Sequence
  Dolichyl-diphosphooligosaccharide-proteinosyltransferase subunit 1 (381-388)
aucgagauugacagccccuacgaa

SEQ ID NO: 74292 - RNA, 33 nt, Artificial Sequence
  Complex I assembly factor TMEM126B, mitochondrial (24-34)
aucgagauuauagaaaagaacuucgacuaccug

SEQ ID NO: 74293 - RNA, 30 nt, Artificial Sequence
  Copper transport protein ATOX1 (42-51)
aucgagagcgaacacuccauggacacccug

SEQ ID NO: 74294 - RNA, 33 nt, Artificial Sequence
  Copper transport protein ATOX1 (42-52)
aucgagagcgaacacuccauggacacccugcuc

SEQ ID NO: 74295 - RNA, 24 nt, Artificial Sequence
  N-acyl-aromatic-L-amino acid amidohydrolase (carboxylate-forming) (191-198)
aucuucagcagaaugaggacccug

SEQ ID NO: 74296 - RNA, 30 nt, Artificial Sequence
  Cadherin-19 (91-100)
aucauugacgagagaaccggcgauauauac

SEQ ID NO: 74297 - RNA, 27 nt, Artificial Sequence
  40S ribosomal protein S17 (95-103)
aucauugagguggaccccgauaccaag

SEQ ID NO: 74298 - RNA, 30 nt, Artificial Sequence
  FACT complex subunit SSRP1 (30-39)
aucauuuucaagaacagcaaaaccggcaag

SEQ ID NO: 74299 - RNA, 27 nt, Artificial Sequence
  Neuron navigator 2 (2224-2232)
aucauucuggacaaccuccaccaugug

SEQ ID NO: 74300 - RNA, 42 nt, Artificial Sequence
  Putative heat shock 70 kDa protein 7 (30-43)
auccuggccaacgaccagggcaauagaaccacacccagcuac

SEQ ID NO: 74301 - RNA, 30 nt, Artificial Sequence
  Fer-1-like protein 5 (1201-1210)
auccuggccagcugcgagcucauucuucag

SEQ ID NO: 74302 - RNA, 30 nt, Artificial Sequence
  U6 snRNA-associated Sm-like protein LSm8 (16-25)
auccuggacgagagccacgaaagaguguuc

SEQ ID NO: 74303 - RNA, 30 nt, Artificial Sequence
  Cleft lip and palate transmembrane protein 1 (410-419)
auccuggacaacgagaccaauuucgugguc

SEQ ID NO: 74304 - RNA, 27 nt, Artificial Sequence
  Vesicle transport protein USE1 (249-257)
auccuguucauuagaauaaugcccaag

SEQ ID NO: 74305 - RNA, 30 nt, Artificial Sequence
  TELO2-interacting protein 1 homolog (52-61)
auccuguucccccucagauuuacccuuaag

SEQ ID NO: 74306 - RNA, 51 nt, Artificial Sequence
  Transforming growth factor beta receptor type 3 (374-390)
auccugcucgaccccggcgcccuuccugcucugcagaacccaccgauuaga

SEQ ID NO: 74307 - RNA, 33 nt, Artificial Sequence
  Serine/threonine-protein kinase Sgk1 (323-333)
auccugcucgacagccagggccacauugugcuu

SEQ ID NO: 74308 - RNA, 33 nt, Artificial Sequence
  Eukaryotic translation initiation factor 3 subunit A (542-552)
auccugcaggagaaggaagagcaacaccagcuc

SEQ ID NO: 74309 - RNA, 27 nt, Artificial Sequence
  Inositol-trisphosphate 3-kinase B (133-141)
auccugcagagagagcuccaaaacgug

SEQ ID NO: 74310 - RNA, 30 nt, Artificial Sequence
  Myotubularin-related protein 6 isoform X4 (104-113)
auccugaccaaggagcuccuucacagcgug

SEQ ID NO: 74311 - RNA, 39 nt, Artificial Sequence
  Sodium/potassium/calcium exchanger 5 (18-30)
auccugugggccaccgcucaccucccccuuagcggcaca

SEQ ID NO: 74312 - RNA, 33 nt, Artificial Sequence
  Chromosome transmission fidelity protein 8 homolog (58-68)
auccuguacggcaagauuauacaccucgagaaa

SEQ ID NO: 74313 - RNA, 30 nt, Artificial Sequence
  40S ribosomal protein S3 (188-197)
aucaugcugcccugggacccuaccggcaag

SEQ ID NO: 74314 - RNA, 24 nt, Artificial Sequence
  Vimentin (182-189)
aucaugagacugagggagaagcuc

SEQ ID NO: 74315 - RNA, 36 nt, Artificial Sequence
  MAGUK p55 subfamily member 2 (395-406)
aucaugugggaccccgauagauacggcaccacagug

SEQ ID NO: 74316 - RNA, 27 nt, Artificial Sequence
  Bromodomain adjacent to zinc finger domain protein 1A (730-738)
aucaacugcgugaccagagagccccug

SEQ ID NO: 74317 - RNA, 27 nt, Artificial Sequence
  Sarcospan (117-125)
auccaguucagcaugaagcugcucuac

SEQ ID NO: 74318 - RNA, 30 nt, Artificial Sequence
  Catalase (347-356)
auccaguacagcggcgaggugagaagguuc

SEQ ID NO: 74319 - RNA, 51 nt, Artificial Sequence
  Calmodulin (126-142)
aucagagaggccgacauugauggcgacgggcaggugaacuacgaagaguuc

SEQ ID NO: 74320 - RNA, 27 nt, Artificial Sequence
  60S ribosomal protein L32 (21-29)
aucagacaccagagcgacagguacgug

SEQ ID NO: 74321 - RNA, 27 nt, Artificial Sequence
  ATP-citrate synthase (6-14)
aucagcgagcagaccggcaaggaacug

SEQ ID NO: 74322 - RNA, 27 nt, Artificial Sequence
  XAGE1D protein (105-113)
aucagccagacccccggcauuaaccug

SEQ ID NO: 74323 - RNA, 24 nt, Artificial Sequence
  Metalloproteinase inhibitor 4 (52-59)
aucagcuccgagaagguggucccc

SEQ ID NO: 74324 - RNA, 36 nt, Artificial Sequence
  Transmembraneoprotein NMB (483-494)
aucagcgugcccgacagagauccugccuccccacug

SEQ ID NO: 74325 - RNA, 33 nt, Artificial Sequence
  40S ribosomal protein S18 (30-40)
aucaccgccauuaagggcguggggagaagguac

SEQ ID NO: 74326 - RNA, 27 nt, Artificial Sequence
  Melanoma-associated antigen D4 (549-557)
aucaccgacgauuucgugaagcagaaa

SEQ ID NO: 74327 - RNA, 45 nt, Artificial Sequence
  Melanocyte protein PMEL (216-230)
aucaccgaccaggugcccuucagcgucuccguuucucaacugaga

SEQ ID NO: 74328 - RNA, 33 nt, Artificial Sequence
  Voltage-dependent L-type calcium channel subunit alpha-1C (1300-1310)
aucaccgagaacgccgaagagaauagcagaauu

SEQ ID NO: 74329 - RNA, 30 nt, Artificial Sequence
  Beta-adrenergic receptor kinase 2 (53-62)
aucaccuucgacaagauuuuuaaccagaaa

SEQ ID NO: 74330 - RNA, 39 nt, Artificial Sequence
  Galectin-3 (132-144)
aucaccauucugggcacagugaagcccaacgccaauaga

SEQ ID NO: 74331 - RNA, 45 nt, Artificial Sequence
  Galectin-3 (132-146)
aucaccauucugggcacagugaagcccaacgccaauagaauagcu

SEQ ID NO: 74332 - RNA, 27 nt, Artificial Sequence
  Catalase (42-50)
aucaccgugggccccagagggccucug

SEQ ID NO: 74333 - RNA, 27 nt, Artificial Sequence
  Dipeptidyl peptidase 4 (185-193)
aucaccuggacaggcaaggaggacauu

SEQ ID NO: 74334 - RNA, 33 nt, Artificial Sequence
  Galectin-8 (91-101)
aucaccuacgacacacccuucaagagagagaaa

SEQ ID NO: 74335 - RNA, 36 nt, Artificial Sequence
  Proteasome subunit alpha type-7 (133-144)
aucgugggcuucgacuuugaugggacccccagacug

SEQ ID NO: 74336 - RNA, 27 nt, Artificial Sequence
  F-box only protein 11 (19-27)
aucgugcacaccaacuucgucgagaag

SEQ ID NO: 74337 - RNA, 27 nt, Artificial Sequence
  Protein SMG5 (881-889)
aucgugauuauacccagaaccgucauc

SEQ ID NO: 74338 - RNA, 39 nt, Artificial Sequence
  Zinc finger CCHC domain-containing protein 10 (33-45)
aucgugauuagagacagcgucgcccaggcuggccugaag

SEQ ID NO: 74339 - RNA, 30 nt, Artificial Sequence
  Teneurin-4 (347-356)
aucgugauuagcgccacccuggucauacuc

SEQ ID NO: 74340 - RNA, 27 nt, Artificial Sequence
  U4/U6 small nuclear ribonucleoprotein Prp31 (462-470)
aucgugaacccccaggccgcugagaag

SEQ ID NO: 74341 - RNA, 27 nt, Artificial Sequence
  P antigen family member 5 (47-55)
aucgugcagcaacccaccgaggaaaag

SEQ ID NO: 74342 - RNA, 30 nt, Artificial Sequence
  Carbohydrate sulfotransferase 9 (266-275)
aucuacaccagacugaacacauauacuaag

SEQ ID NO: 74343 - RNA, 39 nt, Artificial Sequence
  Cap-specific mRNAucleoside-2'-O-)-methyltransferase 1 (72-84)
aaggccgacagccugguggagggcaccuccucuagauac

SEQ ID NO: 74344 - RNA, 27 nt, Artificial Sequence
  Antigen KI-67 (793-801)
aaggccgacguggaggaagaguuccug

SEQ ID NO: 74345 - RNA, 30 nt, Artificial Sequence
  Coatomer subunit zeta-1 (19-28)
aaggccuucgagaaaaacaucuuuaauaag

SEQ ID NO: 74346 - RNA, 33 nt, Artificial Sequence
  Zinc finger and SCAN domain-containing protein 21 (278-288)
aaggccuucggccagagcuccgaccugcucaaa

SEQ ID NO: 74347 - RNA, 27 nt, Artificial Sequence
  Estradiol 17-beta-dehydrogenase 11 (153-161)
aaggccuuccugcccgcuaugaccaaa

SEQ ID NO: 74348 - RNA, 30 nt, Artificial Sequence
  Antigen KI-67 (828-837)
aaggccuucaugggcacccccgugcagaaa

SEQ ID NO: 74349 - RNA, 27 nt, Artificial Sequence
  Zinc finger protein 7 (98-106)
aaggccuucagccaguccucuucacug

SEQ ID NO: 74350 - RNA, 33 nt, Artificial Sequence
  Zinc finger protein 430 (519-529)
aaggccuucagccaguccucuacccugacaaaa

SEQ ID NO: 74351 - RNA, 30 nt, Artificial Sequence
  Xaa-Pro dipeptidase (484-493)
aaggccuucacccccuuuagcggcccuaaa

SEQ ID NO: 74352 - RNA, 33 nt, Artificial Sequence
  Zinc finger protein 721 (184-194)
aaggccuucaccagcuccacaacucugacgaaa

SEQ ID NO: 74353 - RNA, 27 nt, Artificial Sequence
  Dynactin subunit 1 (141-149)
aaggcccacgcuaaagcaaucgagaug

SEQ ID NO: 74354 - RNA, 27 nt, Artificial Sequence
  Histone-binding protein RBBP7 (263-271)
aaggccaucuucaccggccacagcgcu

SEQ ID NO: 74355 - RNA, 27 nt, Artificial Sequence
  Protein ECT2 (595-603)
aaggccaucggcagccugaaagaggug

SEQ ID NO: 74356 - RNA, 27 nt, Artificial Sequence
  Nitrogen permease regulator 3-like protein (253-261)
aaggccaucagacccuaccacgcucug

SEQ ID NO: 74357 - RNA, 27 nt, Artificial Sequence
  Elongation factor 1-gamma (193-201)
aaggccaaagaccccuucgcucaccug

SEQ ID NO: 74358 - RNA, 33 nt, Artificial Sequence
  Dynamin-like 120 kDa protein, mitochondrial (154-164)
aaggcccugcccagcuccgaggaccucgugaaa

SEQ ID NO: 74359 - RNA, 30 nt, Artificial Sequence
  Annexin A1 (98-107)
aaggcccugaccggccaccucgaggaagug

SEQ ID NO: 74360 - RNA, 27 nt, Artificial Sequence
  Phosphoinositide 3-kinase regulatory subunit 4 (572-580)
aaggccaacgacgugcugcucagccac

SEQ ID NO: 74361 - RNA, 27 nt, Artificial Sequence
  UDP-glucose:glycoprotein glucosyltransferase 2 (1135-1143)
aaggccaaccccggcgcuuggauccug

SEQ ID NO: 74362 - RNA, 27 nt, Artificial Sequence
  Importin subunit alpha-1 (486-494)
aaggccagccugucccucaucgagaaa

SEQ ID NO: 74363 - RNA, 27 nt, Artificial Sequence
  Ectonucleoside triphosphate diphosphohydrolase 6 (156-164)
aaggccaccccccuggugcucaaagcu

SEQ ID NO: 74364 - RNA, 27 nt, Artificial Sequence
  Protein FAM161A (564-572)
aaggccuacgacagccaccagucccug

SEQ ID NO: 74365 - RNA, 33 nt, Artificial Sequence
  Gamma-soluble NSF attachment protein (76-86)
aaggccuacgagcaggcuggcaugaugcugaaa

SEQ ID NO: 74366 - RNA, 27 nt, Artificial Sequence
  Cell division cycle protein 23 homolog (85-93)
aaggccuacuucgacgugaaagaguau

SEQ ID NO: 74367 - RNA, 33 nt, Artificial Sequence
  28S ribosomal protein S29, mitochondrial (321-331)
aaggccuaccugccccaggagcuccuuggcaaa

SEQ ID NO: 74368 - RNA, 27 nt, Artificial Sequence
  NF-kappa-B inhibitor zeta (545-553)
aaggccuacaacggcaauaccgcucug

SEQ ID NO: 74369 - RNA, 27 nt, Artificial Sequence
  Protein phosphatase Slingshot homolog 1 (418-426)
aaggccuacaacuaugugaaacagaag

SEQ ID NO: 74370 - RNA, 27 nt, Artificial Sequence
  Integrator complex subunit 11 (122-130)
aaggccuacuaugcuggccacgugcug

SEQ ID NO: 74371 - RNA, 27 nt, Artificial Sequence
  Switch-associated protein 70 (278-286)
aagugcuucgacaaaaccuuugagauc

SEQ ID NO: 74372 - RNA, 30 nt, Artificial Sequence
  Zinc finger protein 860 (39-48)
aagugccuggaccccacccagagagcccuc

SEQ ID NO: 74373 - RNA, 30 nt, Artificial Sequence
  Keratin, type II cytoskeletal 1 (289-298)
aaggacguggauggcgccuacaugaccaaa

SEQ ID NO: 74374 - RNA, 30 nt, Artificial Sequence
  Little elongation complex subunit 1 (521-530)
aaggaggccgcucccggcaaaagcgaacug

SEQ ID NO: 74375 - RNA, 30 nt, Artificial Sequence
  Rho guanine nucleotide exchange factor 40 (405-414)
aaggaggacgccagccaccaggaagcucug

SEQ ID NO: 74376 - RNA, 27 nt, Artificial Sequence
  Ras-related protein Ral-A (118-126)
aaggaggacgaaaacgugcccuuccug

SEQ ID NO: 74377 - RNA, 27 nt, Artificial Sequence
  DNA ligase 3 (389-397)
aaggaggacgaacagcaacaggcccug

SEQ ID NO: 74378 - RNA, 27 nt, Artificial Sequence
  Protein SOGA1 (625-633)
aaggaggaccagcaaagagcccugcuc

SEQ ID NO: 74379 - RNA, 27 nt, Artificial Sequence
  Dolichyl-diphosphooligosaccharide-proteinosyltransferase subunit 2 (229-237)
aaggaggaccaggugauccaacugaug

SEQ ID NO: 74380 - RNA, 30 nt, Artificial Sequence
  DNA replication licensing factor MCM7 (259-268)
aaggaggacgugaacgaagccaucagacug

SEQ ID NO: 74381 - RNA, 30 nt, Artificial Sequence
  Spermine synthase (169-178)
aaggaggacuacaccggcaaagaugugcug

SEQ ID NO: 74382 - RNA, 27 nt, Artificial Sequence
  Integrin alpha-7 (1092-1100)
aaggaggaaaaaaccggcacaauccug

SEQ ID NO: 74383 - RNA, 27 nt, Artificial Sequence
  Eukaryotic translation initiation factor 3 subunit A (105-113)
aaggaggaaagccagcaaauggugcug

SEQ ID NO: 74384 - RNA, 39 nt, Artificial Sequence
  Solute carrier family 43 member 3 (268-280)
aaggaggaaacccccggcgccgggcagaaacaagagcug

SEQ ID NO: 74385 - RNA, 27 nt, Artificial Sequence
  Ras-related protein Rab-17 (148-156)
aaggaguucgccgacagccagaaacug

SEQ ID NO: 74386 - RNA, 36 nt, Artificial Sequence
  Exportin-1 (1023-1034)
aaggaguucgccggcgaagacaccagcgaucuguuu

SEQ ID NO: 74387 - RNA, 24 nt, Artificial Sequence
  Heat shock protein HSP 90-alpha (656-663)
aaggaguucgaaggcaaaacccug

SEQ ID NO: 74388 - RNA, 27 nt, Artificial Sequence
  Protein phosphatase Slingshot homolog 1 (292-300)
aaggaguucaucgacaacgaaaugcug

SEQ ID NO: 74389 - RNA, 30 nt, Artificial Sequence
  Oxidative stress-induced growth inhibitor 1 (196-205)
aaggagcacgccaucccccaugugguccug

SEQ ID NO: 74390 - RNA, 27 nt, Artificial Sequence
  Trophinin (105-113)
aaggagaucgacaaacagagcucccug

SEQ ID NO: 74391 - RNA, 30 nt, Artificial Sequence
  Heat shock 70 kDa protein 4 (766-775)
aaggagaucgaagccaaaauuaaggagcug

SEQ ID NO: 74392 - RNA, 27 nt, Artificial Sequence
  WASH complex subunit 7 (678-686)
aaggagaucgaaaaagaccugagacuc

SEQ ID NO: 74393 - RNA, 30 nt, Artificial Sequence
  THO complex subunit 5 homolog (217-226)
aaggagaucgaagugaaaaaggaguaccug

SEQ ID NO: 74394 - RNA, 30 nt, Artificial Sequence
  Calcium/calmodulin-dependent protein kinase type IV (135-144)
aaggagaucuucgaaacccccacagagauu

SEQ ID NO: 74395 - RNA, 33 nt, Artificial Sequence
  Kinesin-like protein KIF2C (653-663)
aaggagaucauucagcaaggccccgacuggcug

SEQ ID NO: 74396 - RNA, 30 nt, Artificial Sequence
  Spectrin beta chain, non-erythrocytic 1 (924-933)
aaggagaucaaagcccagcaagacaagcug

SEQ ID NO: 74397 - RNA, 27 nt, Artificial Sequence
  Eukaryotic translation initiation factor 3 subunit E (29-37)
aaggagaucuacaacgaaaaagagcug

SEQ ID NO: 74398 - RNA, 27 nt, Artificial Sequence
  Telomere-associated protein RIF1 (519-527)
aaggagaaacccggcagcgaagugcug

SEQ ID NO: 74399 - RNA, 30 nt, Artificial Sequence
  Beclin-1 (185-194)
aaggagcuggcccucgaagaggaaagacuu

SEQ ID NO: 74400 - RNA, 27 nt, Artificial Sequence
  Ras and Rab interactor 1 (172-180)
aaggagcuggaagccaucagccaccuc

SEQ ID NO: 74401 - RNA, 27 nt, Artificial Sequence
  Liprin-beta-1 (682-690)
aaggagcugggcaucaaacacagccuc

SEQ ID NO: 74402 - RNA, 33 nt, Artificial Sequence
  Protein S100-A1 (32-42)
aaggagcugaaagaacuccuucagaccgagcug

SEQ ID NO: 74403 - RNA, 27 nt, Artificial Sequence
  L-dopachrome tautomerase (418-426)
aaggagcugcccagccuccacgugcuu

SEQ ID NO: 74404 - RNA, 30 nt, Artificial Sequence
  Loss of heterozygosity 12 chromosomal region 1 protein (119-128)
aaggagauggaccugagcguggaaacccuc

SEQ ID NO: 74405 - RNA, 27 nt, Artificial Sequence
  Disabled homolog 2 (652-660)
aaggagauguucaaagacuuucagcug

SEQ ID NO: 74406 - RNA, 36 nt, Artificial Sequence; identical to SEQ ID NO: 50179
  T-complex protein 1 subunit epsilon (113-124)

SEQ ID NO: 74407 - RNA, 33 nt, Artificial Sequence
  Ras-related protein Rab-13 (99-109)
aaggagaacgccagcgcuggcguggaaagacug

SEQ ID NO: 74408 - RNA, 30 nt, Artificial Sequence; identical to SEQ ID NO: 50181
  Ras-related protein Rab-34 (152-161)

SEQ ID NO: 74409 - RNA, 30 nt, Artificial Sequence
  AN1-type zinc finger protein 5 (200-209)
aaggagaaccccguggucguugccgaaaaa

SEQ ID NO: 74410 - RNA, 27 nt, Artificial Sequence
  Hypoxia-inducible factor 1-alpha (392-400)
aaggagcccgacgcccugacccuccuu

SEQ ID NO: 74411 - RNA, 27 nt, Artificial Sequence
  P protein (539-547)
aaggagcccagcgaaaucguggagcug

SEQ ID NO: 74412 - RNA, 33 nt, Artificial Sequence
  Zinc finger protein 36, C3H1 type-like 2 (102-112)
aaggagcccagcggcgggggagguaccgcccug

SEQ ID NO: 74413 - RNA, 27 nt, Artificial Sequence
  V-type proton ATPase subunit H (86-94)
aaggagcagaccgugcaauacauccug

SEQ ID NO: 74414 - RNA, 33 nt, Artificial Sequence
  Filamin A-interacting protein 1-like (562-572)
aaggagagagacgaucugaaaaacaagcucaaa

SEQ ID NO: 74415 - RNA, 30 nt, Artificial Sequence
  Transcription factor 7-like 2 (348-357)
aaggagagcgccgcuaucaaccagauucug

SEQ ID NO: 74416 - RNA, 27 nt, Artificial Sequence
  Dynactin subunit 2 (127-135)
aaggagagcgccaccgaagagaaacug

SEQ ID NO: 74417 - RNA, 27 nt, Artificial Sequence
  Cullin-1 (229-237)
aaggagagcuucgaaucccaguuucug

SEQ ID NO: 74418 - RNA, 30 nt, Artificial Sequence
  Lysine-specific histone demethylase 1B (522-531)
aaggagagcggcauccaguucuccgaacug

SEQ ID NO: 74419 - RNA, 27 nt, Artificial Sequence
  Ras-related GTP-binding protein D (313-321)
aaggagagcaccgccaucauuaaacug

SEQ ID NO: 74420 - RNA, 27 nt, Artificial Sequence
  Ras-related protein Rab-7a (48-56)
aaggaggugauggucgacgauagacug

SEQ ID NO: 74421 - RNA, 27 nt, Artificial Sequence
  Cold shock domain-containing protein E1 (675-683)
aaggaggugcaggacggcaucgaacug

SEQ ID NO: 74422 - RNA, 24 nt, Artificial Sequence
  Band 4.1-like protein 2 (195-202)
aaggaggugcagaccaacgaacug

SEQ ID NO: 74423 - RNA, 27 nt, Artificial Sequence
  Nuclear receptor subfamily 4 group A member 3 (320-328)
aaggagguggucagaaccgacagccug

SEQ ID NO: 74424 - RNA, 33 nt, Artificial Sequence
  RuvB-like 1 (68-78)
aaggagguguacgaaggcgaggucaccgaacug

SEQ ID NO: 74425 - RNA, 27 nt, Artificial Sequence
  F-box only protein 32 (43-51)
aaggagguguacaacaaagaaaaucug

SEQ ID NO: 74426 - RNA, 27 nt, Artificial Sequence
  Armadillo repeat-containing X-linked protein 1 (379-387)
aaggagugggacagagaaauccugcuc

SEQ ID NO: 74427 - RNA, 27 nt, Artificial Sequence
  Sentrin-specific protease 6 (154-162)
aaggaguaccccccucacgugcagaaa

SEQ ID NO: 74428 - RNA, 33 nt, Artificial Sequence
  Iron-responsive element-binding protein 2 (24-34)
aaguucuuugacgugagcaaacugggcaccaag

SEQ ID NO: 74429 - RNA, 27 nt, Artificial Sequence
  Nucleolin (110-118)
aagggcgccacccccgggaaagcucug

SEQ ID NO: 74430 - RNA, 27 nt, Artificial Sequence
  PRELI domain-containing protein 1, mitochondrial (160-168)
aagggcuucgaguacauccuggccaaa

SEQ ID NO: 74431 - RNA, 30 nt, Artificial Sequence
  CD302 antigen (84-93)
aagggccccgacgauauccugcucgggaug

SEQ ID NO: 74432 - RNA, 27 nt, Artificial Sequence
  Epithelial discoidin domain-containing receptor 1 (781-789)
aagaucgccgacuucggcaugagcaga

SEQ ID NO: 74433 - RNA, 33 nt, Artificial Sequence; identical to SEQ ID NO: 50206
  Merlin (209-219)

SEQ ID NO: 74434 - RNA, 27 nt, Artificial Sequence
  Afadin (742-750)
aagaucgacgaugugcugcacacccuc

SEQ ID NO: 74435 - RNA, 27 nt, Artificial Sequence
  Leucine-rich repeat-containing protein 9 (112-120)
aagaucgagaaccuggaaaaacucauu

SEQ ID NO: 74436 - RNA, 27 nt, Artificial Sequence
  Gamma-interferon-inducible protein 16 (67-75)
aagaucuucgaggacauucccacccug

SEQ ID NO: 74437 - RNA, 30 nt, Artificial Sequence
  Palladin (13-22)
aagaucuucgagggcaugcccgugaccuuu

SEQ ID NO: 74438 - RNA, 30 nt, Artificial Sequence
  Cytochrome c oxidase subunit 2 (217-226)
aagaucuucgagaugggccccguguuuacc

SEQ ID NO: 74439 - RNA, 27 nt, Artificial Sequence
  Small subunit processome component 20 homolog (391-399)
aagaucuucgagagcagauuugaaaaa

SEQ ID NO: 74440 - RNA, 33 nt, Artificial Sequence
  Zinc finger protein 141 (290-300)
aagaucuucaccagcuccucuaacuuugccaaa

SEQ ID NO: 74441 - RNA, 27 nt, Artificial Sequence
  Tudor domain-containing protein 3 (524-532)
aagaucuucuacaacagcggccccaaa

SEQ ID NO: 74442 - RNA, 27 nt, Artificial Sequence
  Cytoskeleton-associated protein 5 (868-876)
aagaucggcgacaaaaacuggaagauu

SEQ ID NO: 74443 - RNA, 27 nt, Artificial Sequence
  Neuron navigator 2 (2313-2321)
aagaucauugacuggauacccaaagug

SEQ ID NO: 74444 - RNA, 36 nt, Artificial Sequence
  RanBP2-like and GRIP domain-containing protein 3 (721-732)
aagauccuggacgauagcgacuccaaccucucugug

SEQ ID NO: 74445 - RNA, 30 nt, Artificial Sequence
  Creatine kinase S-type, mitochondrial (344-353)
aagauccuggagaaccucagacuucagaaa

SEQ ID NO: 74446 - RNA, 27 nt, Artificial Sequence
  Ankyrin repeat and KH domain-containing protein 1 (866-874)
aagauccugaaagagcuccagaaggug

SEQ ID NO: 74447 - RNA, 27 nt, Artificial Sequence
  Protein phosphatase 1 regulatory subunit 21 (355-363)
aagauccugcccuaccagcucaaaaga

SEQ ID NO: 74448 - RNA, 30 nt, Artificial Sequence
  Cytoglobin (125-134)
aagauccugagcggcgugauucucgagguc

SEQ ID NO: 74449 - RNA, 27 nt, Artificial Sequence
  Trimethylguanosine synthase (510-518)
aagauccugagcaaaguggagaaguuc

SEQ ID NO: 74450 - RNA, 33 nt, Artificial Sequence
  X-ray repair cross-complementing protein 6 (451-461)
aagaucauggccacccccgagcaggugggcaaa

SEQ ID NO: 74451 - RNA, 27 nt, Artificial Sequence
  Syntaxin-binding protein 1 (13-21)
aagaucaugcacgacgugauuaaaaag

SEQ ID NO: 74452 - RNA, 27 nt, Artificial Sequence
  Protein S100-A10 (54-62)
aagaucaugaaagaccuggaucagugc

SEQ ID NO: 74453 - RNA, 27 nt, Artificial Sequence
  60S ribosomal protein L26 (28-36)
aagaucaugagcuccccccugucuaaa

SEQ ID NO: 74454 - RNA, 27 nt, Artificial Sequence
  Inversin (350-358)
aagaucaaccccaaugugcaggacuac

SEQ ID NO: 74455 - RNA, 33 nt, Artificial Sequence
  E3 SUMO-protein ligase NSE2 (96-106)
aagauccccgaccugaaacuccuuguggagaag

SEQ ID NO: 74456 - RNA, 27 nt, Artificial Sequence
  Arrestin domain-containing protein 4 (273-281)
aagauccccccugugaccccaagcauu

SEQ ID NO: 74457 - RNA, 27 nt, Artificial Sequence
  Utrophin (2159-2167)
aagaucagcgagucccugagaaccgug

SEQ ID NO: 74458 - RNA, 30 nt, Artificial Sequence
  Nucleolar protein 58 (40-49)
aagaucgugaaacugaagcacuucgagaaa

SEQ ID NO: 74459 - RNA, 36 nt, Artificial Sequence
  ATP synthase subunit g, mitochondrial (55-66)
aagaucgugaacagcgcccagaccggcuccuucaaa

SEQ ID NO: 74460 - RNA, 36 nt, Artificial Sequence
  Pre-mRNA-processing factor 19 (375-386)
aagaucugggaccugaaagagagaaccaacguggcc

SEQ ID NO: 74461 - RNA, 30 nt, Artificial Sequence
  Melanoma-associated antigen 12 (220-229)
aagaucugggaggaacugagcgugcucgag

SEQ ID NO: 74462 - RNA, 27 nt, Artificial Sequence
  60S ribosomal protein L3 (278-286)
aagaucuacaaaauuggccagggguau

SEQ ID NO: 74463 - RNA, 33 nt, Artificial Sequence
  SWI/SNF-related matrix-associated actin-dependent regulator of chromatin subfamily A member 5 (411-421)
aagaucuacgugggccugagcaaaaugcagaga

SEQ ID NO: 74464 - RNA, 27 nt, Artificial Sequence
  Dynein heavy chain 5, axonemal (1406-1414)
aagaaacagcugaaccuccuucaaaag

SEQ ID NO: 74465 - RNA, 27 nt, Artificial Sequence
  Tubulin alpha-1C chain (89-97)
aagcuggccgaccagugcaccggccuc

SEQ ID NO: 74466 - RNA, 27 nt, Artificial Sequence
  Protein TANC1 (1398-1406)
aagcugugccccaccaaccaggaggug

SEQ ID NO: 74467 - RNA, 30 nt, Artificial Sequence
  Golgi-associated PDZ and coiled-coil motif-containing protein (449-458)
aagcuggacgaucuccacacccuuuaccau

SEQ ID NO: 74468 - RNA, 27 nt, Artificial Sequence
  Dystonin (4697-4705)
aagcuggacgauaugcucagcgagcuu

SEQ ID NO: 74469 - RNA, 27 nt, Artificial Sequence
  Prefoldin subunit 3 (21-29)
aagcuggacgagcaguaccaaaaauau

SEQ ID NO: 74470 - RNA, 30 nt, Artificial Sequence
  DNA topoisomerase 2-alpha (278-287)
aagcuggacgagaccggcaacagccucaaa

SEQ ID NO: 74471 - RNA, 30 nt, Artificial Sequence
  Cysteine-tRNA ligase, cytoplasmic (716-725)
aagcuguucgaggcccaggaaaaacucuac

SEQ ID NO: 74472 - RNA, 33 nt, Artificial Sequence
  Pleckstrin homology-like domain family B member 1 (803-813)
aagcuguucgaggaccucgaauuucagcaacuu

SEQ ID NO: 74473 - RNA, 27 nt, Artificial Sequence
  Protein CASP (544-552)
aagcuguucgagaaaaucaaguuucuc

SEQ ID NO: 74474 - RNA, 30 nt, Artificial Sequence
  Integrator complex subunit 11 (251-260)
aagcuguucauccccuggaccaaccagaaa

SEQ ID NO: 74475 - RNA, 27 nt, Artificial Sequence
  Lathosterol oxidase (289-297)
aagcuguucaacggcgaguuuaccaaa

SEQ ID NO: 74476 - RNA, 33 nt, Artificial Sequence
  Cytochrome c oxidase subunit 7A2, mitochondrial (33-43)
aagcuguuccaggaggacgaugaaaucccccuc

SEQ ID NO: 74477 - RNA, 30 nt, Artificial Sequence
  Ubiquitin carboxyl-terminal hydrolase 1 (428-437)
aagcuguuccagggccaacucgugcuuaga

SEQ ID NO: 74478 - RNA, 33 nt, Artificial Sequence
  Coatomer subunit gamma-1 (75-85)
aagcuguuccagagcaacgaccccacccucaga

SEQ ID NO: 74479 - RNA, 24 nt, Artificial Sequence
  Probable U3 small nucleolar RNA-associated protein 11 (142-149)
aagcuguucgugaucgcccagaaa

SEQ ID NO: 74480 - RNA, 36 nt, Artificial Sequence
  Thyroid hormone receptor-associated protein 3 (547-558)
aagcugggcgccaaaggggacuuccccaccggaaag

SEQ ID NO: 74481 - RNA, 27 nt, Artificial Sequence
  F-box only protein 7 (249-257)
aagcugggcgagaacguggccaauauc

SEQ ID NO: 74482 - RNA, 27 nt, Artificial Sequence
  Vam6/Vps39-like protein (271-279)
aagcugggcaccgaccccacacacgug

SEQ ID NO: 74483 - RNA, 27 nt, Artificial Sequence
  Zinc finger protein 106 (287-295)
aagcugggcaccguggccacauacaga

SEQ ID NO: 74484 - RNA, 30 nt, Artificial Sequence
  Large subunit GTPase 1 homolog (102-111)
aagcugcacgaggaaaacaaacaguuccuc

SEQ ID NO: 74485 - RNA, 27 nt, Artificial Sequence
  Serine/threonine-protein kinase RIO2 (60-68)
aagcugaucgccugggagagaaccaaa

SEQ ID NO: 74486 - RNA, 36 nt, Artificial Sequence
  Inter-alpha-trypsin inhibitor heavy chain H5 (795-806)
aagcugaucgacggcgaguacaaagauuaucucgcc

SEQ ID NO: 74487 - RNA, 27 nt, Artificial Sequence
  Elongation of very long chain fatty acids protein 5 (120-128)
aagcugaucgaguucauggacaccuuu

SEQ ID NO: 74488 - RNA, 27 nt, Artificial Sequence
  Transcription factor E2F4 (96-104)
aagcugaucgagcucaaagccgaaauu

SEQ ID NO: 74489 - RNA, 27 nt, Artificial Sequence
  Dedicator of cytokinesis protein 9 (1738-1746)
aagcugaucauucccauauacgagaaa

SEQ ID NO: 74490 - RNA, 27 nt, Artificial Sequence
  Amyloid-like protein 2 (10-18)
aagcugaaagaccucgccuuccuuaag

SEQ ID NO: 74491 - RNA, 27 nt, Artificial Sequence
  Kinesin-like protein KIF20B (1224-1232)
aagcugaaagaggaaaucacccagcuc

SEQ ID NO: 74492 - RNA, 27 nt, Artificial Sequence
  Dystonin (2863-2871)
aagcugaaagagagccucgaaaaggcc

SEQ ID NO: 74493 - RNA, 27 nt, Artificial Sequence
  Heat shock 70 kDa protein 4 (124-132)
aagcugaaagagaccgccgaaagcgug

SEQ ID NO: 74494 - RNA, 27 nt, Artificial Sequence
  Lon protease homolog 2, peroxisomal (304-312)
aagcugaaaaagagagugcucgaguac

SEQ ID NO: 74495 - RNA, 27 nt, Artificial Sequence
  Cytoplasmic dynein 1 heavy chain 1 (681-689)
aagcugaaacaggacggcgauagcuuc

SEQ ID NO: 74496 - RNA, 33 nt, Artificial Sequence
  E3 ubiquitin-protein ligase UBR3 (1192-1202)
aagcugcucgccgaguucgcuagcagacagaaa

SEQ ID NO: 74497 - RNA, 30 nt, Artificial Sequence
  Cytoplasmic dynein 1 heavy chain 1 (1715-1724)
aagcugcucgccgagagcgugaccgaaguc

SEQ ID NO: 74498 - RNA, 27 nt, Artificial Sequence
  WD repeat and HMG-box DNA-binding protein 1 (77-85)
aagcugcucgccauccccguggagaaa

SEQ ID NO: 74499 - RNA, 36 nt, Artificial Sequence
  Tight junction-associated protein 1 (150-161)
aagcugcucgacgccaaaaacaccaucaauaagcuu

SEQ ID NO: 74500 - RNA, 30 nt, Artificial Sequence
  Protein FAM32A (36-45)
aagcugcucgaggccaugggcaccagcaaa

SEQ ID NO: 74501 - RNA, 30 nt, Artificial Sequence
  SEC14 domain and spectrin repeat-containing protein 1 (418-427)
aagcugcucgaggaaaaacuuaagagcgug

SEQ ID NO: 74502 - RNA, 27 nt, Artificial Sequence
  Probable dimethyladenosine transferase (73-81)
aagcugcucgagaaagccaagaaagug

SEQ ID NO: 74503 - RNA, 27 nt, Artificial Sequence
  Polymerase I and transcript release factor (109-117)
aagcugcucgagaaagugagaaagguc

SEQ ID NO: 74504 - RNA, 27 nt, Artificial Sequence
  Retinaldehyde-binding protein 1 (261-269)
aagcugcucgagagaguguucguccac

SEQ ID NO: 74505 - RNA, 27 nt, Artificial Sequence
  Ubiquitin-conjugating enzyme E2 Q1 (46-54)
aagcugcucgagagcaucuuccacaga

SEQ ID NO: 74506 - RNA, 27 nt, Artificial Sequence
  S-adenosylmethionine decarboxylase proenzyme (12-20)
aagcugcucgaggugugguucagcaga

SEQ ID NO: 74507 - RNA, 30 nt, Artificial Sequence
  General transcription factor 3C polypeptide 1 (82-91)
aagcugcucaaagaguucaagagaaacgac

SEQ ID NO: 74508 - RNA, 30 nt, Artificial Sequence
  Enhancer of mRNA-decapping protein 4 (1087-1096)
aagcugcucaaaagcaagaaccuuaccgac

SEQ ID NO: 74509 - RNA, 36 nt, Artificial Sequence
  Growth arrest and DNA damage-inducible protein GADD45 alpha (45-56)
aagcugcucaacguggaccccgauaaugucguucuu

SEQ ID NO: 74510 - RNA, 30 nt, Artificial Sequence
  Box C/D snoRNA protein 1 (321-330)
aagcugcuccccaacggcuucaccaaaaga

SEQ ID NO: 74511 - RNA, 27 nt, Artificial Sequence
  HMG box-containing protein 1 (263-271)
aagcugcucagccacgaggaauccgug

SEQ ID NO: 74512 - RNA, 36 nt, Artificial Sequence
  Ubiquitin-conjugating enzyme E2 E1 (43-54)
aagcugcucagcaccuccgccaaaagaauccagaag

SEQ ID NO: 74513 - RNA, 33 nt, Artificial Sequence
  Junction plakoglobin (325-335)
aagcugcucuggaccacaagcagagugcuuaaa

SEQ ID NO: 74514 - RNA, 27 nt, Artificial Sequence
  Mitogen-activated protein kinase 6 (549-557)
aagcugaacgaccucaauagcuccgug

SEQ ID NO: 74515 - RNA, 27 nt, Artificial Sequence
  Platelet-activating factor acetylhydrolase IB subunit alpha (71-79)
aagcugaacgaggccaaagaagaguuc

SEQ ID NO: 74516 - RNA, 27 nt, Artificial Sequence
  Structural maintenance of chromosomes protein 1A (1009-1017)
aagcugaacgagcagcaaagcgugcuc

SEQ ID NO: 74517 - RNA, 33 nt, Artificial Sequence
  60S ribosomal protein L4 (327-337)
aagcugaaccccuacgccaaaaccaugagaagg

SEQ ID NO: 74518 - RNA, 27 nt, Artificial Sequence
  Pleckstrin homology domain-containing family A member 5 (187-195)
aagcugaacagccuccccuccgaguac

SEQ ID NO: 74519 - RNA, 27 nt, Artificial Sequence
  RUN and FYVE domain-containing protein 2 (250-258)
aagcugcaggaggaaaaccaccaacuc

SEQ ID NO: 74520 - RNA, 27 nt, Artificial Sequence
  Bardet-Biedl syndrome 5 protein (242-250)
aagcugcaggagagcgugaaagaaauc

SEQ ID NO: 74521 - RNA, 30 nt, Artificial Sequence
  Calponin-3 (64-73)
aagcugcagcccggcagcgugaaaaagguc

SEQ ID NO: 74522 - RNA, 30 nt, Artificial Sequence; identical to SEQ ID NO: 50295
  AP-1 complex subunit beta-1 (876-885)

SEQ ID NO: 74523 - RNA, 27 nt, Artificial Sequence
  RuvB-like 1 (214-222)
aagcugagaggcgagaucaacaaagug

SEQ ID NO: 74524 - RNA, 30 nt, Artificial Sequence; identical to SEQ ID NO: 50297
  Integrin beta-1 (331-340)

SEQ ID NO: 74525 - RNA, 33 nt, Artificial Sequence
  3-hydroxy-3-methylglutaryl-coenzyme A reductase (502-512)
aagcugagcgagcccuccucucuccaguaccuu

SEQ ID NO: 74526 - RNA, 27 nt, Artificial Sequence
  DNA topoisomerase 1 (248-256)
aagcugagccccaaagccgaggaagug

SEQ ID NO: 74527 - RNA, 30 nt, Artificial Sequence
  Neuron navigator 2 (616-625)
aagcugagcuccggccucccccagcaaaaa

SEQ ID NO: 74528 - RNA, 33 nt, Artificial Sequence
  Coatomer subunit alpha (619-629)
aagcuggugggccagagcaucauugccuaccuc

SEQ ID NO: 74529 - RNA, 27 nt, Artificial Sequence
  Proteasome activator complex subunit 3 (201-209)
aagcuggugagcaaaaucgccaaguac

SEQ ID NO: 74530 - RNA, 30 nt, Artificial Sequence
  Coatomer subunit beta' (124-133)
aagcugugggacugggauaaaaaguggagc

SEQ ID NO: 74531 - RNA, 33 nt, Artificial Sequence; identical to SEQ ID NO: 50304
  Treslin (218-228)

SEQ ID NO: 74532 - RNA, 30 nt, Artificial Sequence
  Lambda-crystallin homolog (33-42)
aagcuguacgacaucgagcagcaacagauu

SEQ ID NO: 74533 - RNA, 33 nt, Artificial Sequence
  26S proteasome non-ATPase regulatory subunit 11 (325-335)
aagcuguacgacaaccuccuugagcagaaucug

SEQ ID NO: 74534 - RNA, 27 nt, Artificial Sequence
  Calpain-1 catalytic subunit (654-662)
aagcuguacgagcucaucauuaccaga

SEQ ID NO: 74535 - RNA, 30 nt, Artificial Sequence
  Calpain-1 catalytic subunit (654-663)
aagcuguacgagcucaucauuaccagauau

SEQ ID NO: 74536 - RNA, 27 nt, Artificial Sequence
  Signal recognition particle 9 kDa protein (16-24)
aagcuguaccucgccgaccccaugaaa

SEQ ID NO: 74537 - RNA, 27 nt, Artificial Sequence
  Gap junction alpha-3 protein (313-321)
aagcuguacaacggccaccaucaccuc

SEQ ID NO: 74538 - RNA, 27 nt, Artificial Sequence
  Dedicator of cytokinesis protein 5 (1299-1307)
aagcuguaccaggagaucauuagcuau

SEQ ID NO: 74539 - RNA, 30 nt, Artificial Sequence
  Rab GDP dissociation inhibitor beta (130-139)
aagcuguacagcgagucccucgccagauau

SEQ ID NO: 74540 - RNA, 27 nt, Artificial Sequence
  2',3'-cyclic-nucleotide 3'-phosphodiesterase (351-359)
aagcuguacagccucggcaacgggaga

SEQ ID NO: 74541 - RNA, 27 nt, Artificial Sequence
  Cytochrome b-c1 complex subunit 9 (9-17)
aagcuguacagccuccuuuucagaagg

SEQ ID NO: 74542 - RNA, 30 nt, Artificial Sequence
  Dual specificity tyrosine-phosphorylation-regulated kinase 3 (365-374)
aagcuguacaccuauauccagagcagauuc

SEQ ID NO: 74543 - RNA, 33 nt, Artificial Sequence
  Something about silencing protein 10 (134-144)
aagcuguacuaugacaccgauuacggcagcaaa

SEQ ID NO: 74544 - RNA, 27 nt, Artificial Sequence
  Stathmin (95-103)
aagauggccgaggaaaaacugacccac

SEQ ID NO: 74545 - RNA, 33 nt, Artificial Sequence
  Stathmin (95-105)
aagauggccgaggaaaaacugacccacaagaug

SEQ ID NO: 74546 - RNA, 33 nt, Artificial Sequence
  Eukaryotic peptide chain release factor GTP-binding subunit ERF3B (350-360)
aagauggacgaucccaccgugaacuggagcauc

SEQ ID NO: 74547 - RNA, 27 nt, Artificial Sequence
  Dihydropyrimidinase-related protein 1 (341-349)
aagauggacgagaaccaguucguggcc

SEQ ID NO: 74548 - RNA, 27 nt, Artificial Sequence
  Interferon regulatory factor 9 (369-377)
aagauggagcaggccuucgcuagauac

SEQ ID NO: 74549 - RNA, 27 nt, Artificial Sequence
  Guanine nucleotide-binding protein G(i) subunit alpha-1 (197-205)
aagauguucgacgugggcgggcagaga

SEQ ID NO: 74550 - RNA, 39 nt, Artificial Sequence
  Transketolase (516-528)
aagauguucggcaucgacagagaugccauugcucaggca

SEQ ID NO: 74551 - RNA, 33 nt, Artificial Sequence
  Zinc finger FYVE domain-containing protein 16 (254-264)
aagauguuccacgccaaagacaagcugcagcau

SEQ ID NO: 74552 - RNA, 24 nt, Artificial Sequence
  Ubiquitin-associated domain-containing protein 2 (83-90)
aagauguuccaggugcaccaaguc

SEQ ID NO: 74553 - RNA, 33 nt, Artificial Sequence
  Intraflagellar transport protein 88 homolog (227-237)
aagauguucagcaacgccggcauccugaaaaug

SEQ ID NO: 74554 - RNA, 27 nt, Artificial Sequence
  Integrin alpha-7 (1061-1069)
aagaugggcuucuuuaaaagagccaag

SEQ ID NO: 74555 - RNA, 27 nt, Artificial Sequence
  FACT complex subunit SPT16 (120-128)
aagaugaucgaggccauuaaagaaagc

SEQ ID NO: 74556 - RNA, 30 nt, Artificial Sequence
  BRISC and BRCA1-A complex member 1 (126-135)
aagaugaucgagauguucgugagaaccaaa

SEQ ID NO: 74557 - RNA, 27 nt, Artificial Sequence
  Spartin (80-88)
aagaugaaagagacccugcagaacgug

SEQ ID NO: 74558 - RNA, 30 nt, Artificial Sequence
  DNA topoisomerase 1 (262-271)
aagaugcuggaccacgaguacaccacaaaa

SEQ ID NO: 74559 - RNA, 30 nt, Artificial Sequence
  Tropomodulin-3 (307-316)
aagaugcuggaggaaaacaccaauauccuc

SEQ ID NO: 74560 - RNA, 30 nt, Artificial Sequence
  Enhancer of mRNA-decapping protein 3 (373-382)
aagaugcuggagagcaucaccaacgaacuc

SEQ ID NO: 74561 - RNA, 27 nt, Artificial Sequence
  Transient receptor potential cation channel subfamily M member 2 (1336-1344)
aagaugcuggaggugcucgucguuaaa

SEQ ID NO: 74562 - RNA, 27 nt, Artificial Sequence
  MICAL-like protein 1 (843-851)
aagaugcugaaacuccuuggcaacaag

SEQ ID NO: 74563 - RNA, 30 nt, Artificial Sequence
  Cofilin-1 (73-82)
aagaugcugcccgacaaagauugcagauac

SEQ ID NO: 74564 - RNA, 33 nt, Artificial Sequence
  Cofilin-1 (73-83)
aagaugcugcccgacaaagauugcagauacgcc

SEQ ID NO: 74565 - RNA, 27 nt, Artificial Sequence
  Leucine-rich repeat-containing protein 40 (539-547)
aagaugauggagaaccugaccacacuc

SEQ ID NO: 74566 - RNA, 27 nt, Artificial Sequence
  U3 small nucleolar ribonucleoprotein protein MPP10 (357-365)
aagaugaacgagaaaaucgccagccug

SEQ ID NO: 74567 - RNA, 27 nt, Artificial Sequence
  Unconventional myosin-X (643-651)
aagaugcccgaccaguucgaucaagcc

SEQ ID NO: 74568 - RNA, 27 nt, Artificial Sequence
  Voltage-dependent calcium channel subunit alpha-2/delta-1 (39-47)
aagaugcaggaggaccuggugacccuc

SEQ ID NO: 74569 - RNA, 36 nt, Artificial Sequence
  Gamma-secretase C-terminal fragment 59 (620-631)
aagaugcagcaaaacggcuacgagaaucccaccuau

SEQ ID NO: 74570 - RNA, 33 nt, Artificial Sequence
  U2 small nuclear ribonucleoprotein B'' (47-57)
aagaugagaggccaggccuucgugaucuuuaaa

SEQ ID NO: 74571 - RNA, 27 nt, Artificial Sequence
  Aryl hydrocarbon receptor nuclear translocator (104-112)
aagaugaccgccuacaucacagagcug

SEQ ID NO: 74572 - RNA, 27 nt, Artificial Sequence
  Uncharacterized protein C20orf194 (424-432)
aagaugaccuuccacauccaugccgug

SEQ ID NO: 74573 - RNA, 27 nt, Artificial Sequence
  Aryl hydrocarbon receptor nuclear translocator 2 (67-75)
aagaugacccaguacaucacagagcug

SEQ ID NO: 74574 - RNA, 27 nt, Artificial Sequence
  Dual specificity mitogen-activated protein kinase kinase 7 (221-229)
aagaugaccguggccaucgucaaagcu

SEQ ID NO: 74575 - RNA, 36 nt, Artificial Sequence
  A-kinase anchor protein 11 (898-909)
aagaugguggacgagagaaccgauuaccugacaaaa

SEQ ID NO: 74576 - RNA, 33 nt, Artificial Sequence
  5-demethoxyubiquinone hydroxylase, mitochondrial (1-11)
aagaugugggaccaggagaaagaucaccugaag

SEQ ID NO: 74577 - RNA, 36 nt, Artificial Sequence
  5-demethoxyubiquinone hydroxylase, mitochondrial (1-12)
aagaugugggaccaggagaaagaucaccugaagaaa

SEQ ID NO: 74578 - RNA, 45 nt, Artificial Sequence
  Neuroblast differentiation-associated protein AHNAK (5087-5101)
aagauguacuuccccgacguggaguuugauaucaaaagcccuaag

SEQ ID NO: 74579 - RNA, 33 nt, Artificial Sequence
  General transcription factor 3C polypeptide 3 (166-176)
aagauguacggcuauguggacacccugcucaca

SEQ ID NO: 74580 - RNA, 30 nt, Artificial Sequence
  Round spermatid basic protein 1 (272-281)
aagauguacaacaaagaggugcagaccguc

SEQ ID NO: 74581 - RNA, 33 nt, Artificial Sequence
  116 kDa U5 small nuclear ribonucleoprotein component (480-490)
aagauguacagcaccgacgauggcgugcaguuc

SEQ ID NO: 74582 - RNA, 27 nt, Artificial Sequence
  60S ribosomal protein L17 (96-104)
aagaacgccgagagcaaugcugaacug

SEQ ID NO: 74583 - RNA, 27 nt, Artificial Sequence
  Ras GTPase-activating-like protein IQGAP2 (729-737)
aagaacgaccugcucagcgagcuucug

SEQ ID NO: 74584 - RNA, 27 nt, Artificial Sequence
  FACT complex subunit SPT16 (53-61)
aagaacuucgacauggugaucgucuac

SEQ ID NO: 74585 - RNA, 24 nt, Artificial Sequence
  Glutathione S-transferase theta-2B (23-30)
aagaacggcaucccccuggagcuc

SEQ ID NO: 74586 - RNA, 45 nt, Artificial Sequence
  Stromal cell-derived factor 2 (197-211)
aagcccagcgagcugcucaaagccgaagcucaccaugcagagcuu

SEQ ID NO: 74587 - RNA, 36 nt, Artificial Sequence
  Spectrin beta chain, non-erythrocytic 1 (1179-1190)
aagcaggccgaggcuuuccugaacaaucaagaauac

SEQ ID NO: 74588 - RNA, 27 nt, Artificial Sequence
  Melanocyte protein PMEL (629-637)
aagcaggacuucagcgugccccaacug

SEQ ID NO: 74589 - RNA, 24 nt, Artificial Sequence
  EF-hand calcium-binding domain-containing protein 14 (264-271)
aagcaggacauccuguaccuccac

SEQ ID NO: 74590 - RNA, 27 nt, Artificial Sequence
  Syntaxin-binding protein 6 (78-86)
aagcaguucgagggcagcaccuccuuu

SEQ ID NO: 74591 - RNA, 27 nt, Artificial Sequence
  E3 ubiquitin-protein ligase makorin-1 (320-328)
aagcaguucgagagcaaaaucauuaag

SEQ ID NO: 74592 - RNA, 27 nt, Artificial Sequence
  Nucleoside diphosphate-linked moiety X motif 19 (337-345)
aagcaguuccacagaaucgugaccuac

SEQ ID NO: 74593 - RNA, 30 nt, Artificial Sequence
  ADP-ribosylation factor GTPase-activating protein 2 (453-462)
aagcagggcgugaaaagcgucgccgggaag

SEQ ID NO: 74594 - RNA, 27 nt, Artificial Sequence
  Lanosterol 14-alpha demethylase (169-177)
aagcagcacgugagcaucauugagaaa

SEQ ID NO: 74595 - RNA, 30 nt, Artificial Sequence
  60 kDa SS-A/Ro ribonucleoprotein (14-23)
aagcagaucgccaacagccaagacggcuac

SEQ ID NO: 74596 - RNA, 27 nt, Artificial Sequence
  Cytoplasmic dynein 1 heavy chain 1 (3819-3827)
aagcagauccacuuccuguaccaauau

SEQ ID NO: 74597 - RNA, 30 nt, Artificial Sequence
  Catenin alpha-1 (287-296)
aagcagaucauuguggacccccugagcuuc

SEQ ID NO: 74598 - RNA, 30 nt, Artificial Sequence
  Cytoplasmic dynein 1 heavy chain 1 (1464-1473)
aagcagaucagagagguguggaacaccuac

SEQ ID NO: 74599 - RNA, 33 nt, Artificial Sequence
  Proteasome subunit alpha type-4 (158-168)
aagcagaaagagguggaacaacugaucaagaaa

SEQ ID NO: 74600 - RNA, 33 nt, Artificial Sequence
  Tyrosinase (505-515)
aagcagcugcccgaggaaaaacaaccucuccuu

SEQ ID NO: 74601 - RNA, 30 nt, Artificial Sequence
  Guanine nucleotide-binding protein G(s) subunit alpha isoforms short (28-37)
aagcagcugcaaaaagacaagcagguguac

SEQ ID NO: 74602 - RNA, 27 nt, Artificial Sequence
  Small kinetochore-associated protein (228-236)
aagcagauggaggaacugcaagcccuc

SEQ ID NO: 74603 - RNA, 27 nt, Artificial Sequence
  DnaJ homolog subfamily C member 4 (151-159)
aagcagaacaaacaagugcugggcuac

SEQ ID NO: 74604 - RNA, 27 nt, Artificial Sequence
  Cytoplasmic dynein 1 heavy chain 1 (3266-3274)
aagcagcaagaggugaucgccgacaaa

SEQ ID NO: 74605 - RNA, 27 nt, Artificial Sequence
  Pyridoxal kinase (29-37)
aagcagcaaaaccccagacugguguac

SEQ ID NO: 74606 - RNA, 27 nt, Artificial Sequence
  PRELI domain-containing protein 1, mitochondrial (211-219)
aagcagcaacagcagcagcaauucgug

SEQ ID NO: 74607 - RNA, 27 nt, Artificial Sequence
  Mitochondrial import receptor subunit TOM7 homolog (9-17)
aagcagagacugcaacagcucuucaaa

SEQ ID NO: 74608 - RNA, 27 nt, Artificial Sequence
  Protein Simiate (164-172)
aagcaguacgaggaagugauggucaaa

SEQ ID NO: 74609 - RNA, 27 nt, Artificial Sequence
  60S ribosomal protein L35a (45-53)
aagagaugcgccuacguguauaaagcu

SEQ ID NO: 74610 - RNA, 27 nt, Artificial Sequence
  Fructose-bisphosphate aldolase A (82-90)
aagagaugccaguacgugaccgagaaa

SEQ ID NO: 74611 - RNA, 27 nt, Artificial Sequence
  Trafficking kinesin-binding protein 2 (839-847)
aagagacugggcaucgccagggugguc

SEQ ID NO: 74612 - RNA, 27 nt, Artificial Sequence
  Chitinase domain-containing protein 1 (226-234)
aagagagugggccugauccacaugcuc

SEQ ID NO: 74613 - RNA, 33 nt, Artificial Sequence
  Myc proto-oncogene protein (324-334)
aagagagugaaacuggacagcgucaggguucuc

SEQ ID NO: 74614 - RNA, 27 nt, Artificial Sequence
  Msx2-interacting protein (27-35)
aagagauacggcaggguggagagcguc

SEQ ID NO: 74615 - RNA, 33 nt, Artificial Sequence
  DmX-like protein 2 (1150-1160)
aagagcgacgcccugcucuccaaagauagauac

SEQ ID NO: 74616 - RNA, 33 nt, Artificial Sequence
  Mitochondrial Rho GTPase 1 (528-538)
aagagcgaccugcacgaggugaaacaggaauac

SEQ ID NO: 74617 - RNA, 42 nt, Artificial Sequence
  LON peptidase N-terminal domain and RING finger protein 2 (360-373)
aagagcgacaugcugggcaacaccaauuccucugugcucuac

SEQ ID NO: 74618 - RNA, 27 nt, Artificial Sequence
  Transmembrane protein 70, mitochondrial (84-92)
aagagcgaggacggcagacugaucuac

SEQ ID NO: 74619 - RNA, 33 nt, Artificial Sequence
  Coiled-coil domain-containing protein 50 (470-480)
aagagcgaguccucucacaaaggcuuccauuac

SEQ ID NO: 74620 - RNA, 30 nt, Artificial Sequence
  26S proteasome non-ATPase regulatory subunit 2 (545-554)
aagagcgagaccgaacugaaagacacauac

SEQ ID NO: 74621 - RNA, 24 nt, Artificial Sequence
  Clathrin heavy chain 1 (706-713)
aagagcuucgagggccuguuuuac

SEQ ID NO: 74622 - RNA, 27 nt, Artificial Sequence
  Formin-1 (1326-1334)
aagagcuucgagaccacagugagauac

SEQ ID NO: 74623 - RNA, 27 nt, Artificial Sequence
  Ubiquitin-like modifier-activating enzyme 6 (628-636)
aagagcuuccccgccgcuaucgagcac

SEQ ID NO: 74624 - RNA, 30 nt, Artificial Sequence
  Probable cation-transporting ATPase 13A3 (833-842)
aagagcuucuccgugauccuggagcacuuu

SEQ ID NO: 74625 - RNA, 30 nt, Artificial Sequence
  Glutamate-rich WD repeat-containing protein 1 (341-350)
aagagcggcucccccguggccaccuucaaa

SEQ ID NO: 74626 - RNA, 33 nt, Artificial Sequence
  Bifunctional UDP-N-acetylglucosamine 2-epimerase/N-acetylmannosamine kinase (375-385)
aagagcaucgaccugcaggagccccuccaaaaa

SEQ ID NO: 74627 - RNA, 27 nt, Artificial Sequence
  Retinoblastoma-like protein 1 (69-77)
aagagcaucauucccaccgugggcaaa

SEQ ID NO: 74628 - RNA, 30 nt, Artificial Sequence
  NAD(P)H dehydrogenase (quinone) 1 (259-268)
aagagcauccccaccgacaaccagauuaaa

SEQ ID NO: 74629 - RNA, 27 nt, Artificial Sequence
  Small kinetochore-associated protein (70-78)
aagagccugcuccccgugagauccaaa

SEQ ID NO: 74630 - RNA, 33 nt, Artificial Sequence
  Leucine-rich repeat-containing protein 40 (210-220)
aagagccugcccgccgagaucaacagaaugaaa

SEQ ID NO: 74631 - RNA, 27 nt, Artificial Sequence
  Putative ATP-dependent RNA helicase DHX57 (635-643)
aagagcuccgccaccagacugcucuac

SEQ ID NO: 74632 - RNA, 27 nt, Artificial Sequence
  Ankycorbin (402-410)
aagagcucccccucugugcugauccac

SEQ ID NO: 74633 - RNA, 30 nt, Artificial Sequence
  Alternative protein MKKS (31-40)
aagagcucccccguguuccagaucccuaaa

SEQ ID NO: 74634 - RNA, 27 nt, Artificial Sequence
  ATP synthase F(0) complex subunit C2, mitochondrial (31-39)
aagagcaccucccagcugcucucuaga

SEQ ID NO: 74635 - RNA, 27 nt, Artificial Sequence
  Clathrin heavy chain 1 (468-476)
aagagcguggaccccacccuggcccuc

SEQ ID NO: 74636 - RNA, 30 nt, Artificial Sequence
  Programmed cell death 6-interacting protein (574-583)
aagagcgugaacuucgacaugaccuccaaa

SEQ ID NO: 74637 - RNA, 33 nt, Artificial Sequence
  Sodium/potassium-transporting ATPase subunit beta-3 (33-43)
aagagcuggggcucccaguacguggucgggaaa

SEQ ID NO: 74638 - RNA, 27 nt, Artificial Sequence
  Arf-GAP with SH3 domain, ANK repeat and PH domain-containing protein 1 (73-81)
aagaccgccgacaaacugaagcaguac

SEQ ID NO: 74639 - RNA, 30 nt, Artificial Sequence
  DNA-directed RNA polymerase II subunit RPB1 (853-862)
aagaccgccgagacaggcuacauccagaga

SEQ ID NO: 74640 - RNA, 30 nt, Artificial Sequence
  DNA-directed RNA polymerase III subunit RPC1 (133-142)
aagaccgccgagacaggcuacaugcagaga

SEQ ID NO: 74641 - RNA, 27 nt, Artificial Sequence
  Chromodomain-helicase-DNA-binding protein 9 (992-1000)
aagaccgacgauagccuggagaaauac

SEQ ID NO: 74642 - RNA, 27 nt, Artificial Sequence
  TBC1 domain family member 15 (379-387)
aagaccgacgaguacuucagaaugaaa

SEQ ID NO: 74643 - RNA, 27 nt, Artificial Sequence
  Elongator complex protein 6 (28-36)
aagaccgacggcagcuuccuggugcac

SEQ ID NO: 74644 - RNA, 27 nt, Artificial Sequence
  PHD finger-like domain-containing protein 5A (95-103)
aagaccgaccuguucuacgagagaaaa

SEQ ID NO: 74645 - RNA, 30 nt, Artificial Sequence
  EF-hand calcium-binding domain-containing protein 7 (222-231)
aagaccgaccccgagacauuccugaacaaa

SEQ ID NO: 74646 - RNA, 33 nt, Artificial Sequence
  A-kinase anchor protein 13 (287-297)
aagaccgacagcaaauccaucaugagaaugaag

SEQ ID NO: 74647 - RNA, 30 nt, Artificial Sequence
  Tumor necrosis factor receptor superfamily member 14 (17-26)
aagaccgacgugcugagacucguccuuuac

SEQ ID NO: 74648 - RNA, 27 nt, Artificial Sequence
  Poly (ADP-ribose) polymerase 14 (1027-1035)
aagaccgacguggucguuaacagcgug

SEQ ID NO: 74649 - RNA, 30 nt, Artificial Sequence
  Uncharacterized protein C19orf43 (137-146)
aagaccgaggacgaagugcugacaagcaaa

SEQ ID NO: 74650 - RNA, 27 nt, Artificial Sequence
  M-phase phosphoprotein 8 (68-76)
aagaccgagggcgggaaagugcuguac

SEQ ID NO: 74651 - RNA, 33 nt, Artificial Sequence
  Protein PRR5-ARHGAP8 (76-86)
aagaccgagcugggcagcuucuuuacagaauac

SEQ ID NO: 74652 - RNA, 33 nt, Artificial Sequence
  Switch-associated protein 70 (282-292)
aagaccuucgagaucagcgccuccgacaaaaag

SEQ ID NO: 74653 - RNA, 30 nt, Artificial Sequence
  Cytoplasmic dynein 1 heavy chain 1 (872-881)
aagaccuucagcgagauccugaacagagug

SEQ ID NO: 74654 - RNA, 30 nt, Artificial Sequence
  N-acetylglucosamine-6-sulfatase (191-200)
aagaccaucgaccccgagcugcucggcaaa

SEQ ID NO: 74655 - RNA, 33 nt, Artificial Sequence
  DNA/RNA-binding protein KIN17 (231-241)
aagaccaucggcagcuccgccucugugaaaaga

SEQ ID NO: 74656 - RNA, 33 nt, Artificial Sequence
  FH2 domain-containing protein 1 (90-100)
aagaccauccccgaggaacaggugagaggcaaa

SEQ ID NO: 74657 - RNA, 27 nt, Artificial Sequence
  Nck-associated protein 1 (635-643)
aagaccaucagccaggccgugaacaaa

SEQ ID NO: 74658 - RNA, 27 nt, Artificial Sequence
  Endoplasmic reticulum-Golgi intermediate compartment protein 3 (4-12)
aagacccuggaggacuucagagugaaa

SEQ ID NO: 74659 - RNA, 30 nt, Artificial Sequence
  Mitochondrial inner membrane protease ATP23 homolog (100-109)
aagacccuggagacaaaccccuacgugaaa

SEQ ID NO: 74660 - RNA, 36 nt, Artificial Sequence
  cAMP-dependent protein kinase type I-alpha regulatory subunit (123-134)
aagaccauggccgcucuggcaaaagccaucgagaag

SEQ ID NO: 74661 - RNA, 30 nt, Artificial Sequence
  Arfaptin-2 (216-225)
aagaccauggaggacacacugaugacugug

SEQ ID NO: 74662 - RNA, 33 nt, Artificial Sequence
  Telomere-associated protein RIF1 (1915-1925)
aagaccauggagcugaacgugggcaaugaagcc

SEQ ID NO: 74663 - RNA, 33 nt, Artificial Sequence
  Protein GREB1 (304-314)
aagaccaugacaagcacugagcagucccuguac

SEQ ID NO: 74664 - RNA, 36 nt, Artificial Sequence
  Protein GREB1 (304-315)
aagaccaugacaagcacugagcagucccuguacuau

SEQ ID NO: 74665 - RNA, 27 nt, Artificial Sequence
  U3 small nucleolar RNA-associated protein 18 homolog (120-128)
aagaccaaccccaaaauccagagcauu

SEQ ID NO: 74666 - RNA, 27 nt, Artificial Sequence
  Huntingtin-interacting protein 1-related protein (29-37)
aagacccaggccaucagcauuuccaaa

SEQ ID NO: 74667 - RNA, 27 nt, Artificial Sequence
  Proteasome subunit alpha type-1 (121-129)
aagacccagauccccacacaaagauac

SEQ ID NO: 74668 - RNA, 27 nt, Artificial Sequence
  F-box only protein 32 (74-82)
aagacccaguacuuccaccaagagaaa

SEQ ID NO: 74669 - RNA, 33 nt, Artificial Sequence
  Oxysterol-binding protein-related protein 1 (153-163)
aagaccacagagcugacugcccuccuuaacaga

SEQ ID NO: 74670 - RNA, 33 nt, Artificial Sequence
  G patch domain and KOW motifs-containing protein (49-59)
aagaccguggagggcagagaacugcagagcguc

SEQ ID NO: 74671 - RNA, 27 nt, Artificial Sequence
  Melanocyte protein PMEL (154-162)
aagaccugggaccaggugcccuucagc

SEQ ID NO: 74672 - RNA, 36 nt, Artificial Sequence
  Melanocyte protein PMEL (154-165)
aagaccugggaccaggugcccuucagcgucuccguu

SEQ ID NO: 74673 - RNA, 24 nt, Artificial Sequence
  Melanocyte protein PMEL (154-161)
aagaccuggggccaguacuggcaa

SEQ ID NO: 74674 - RNA, 27 nt, Artificial Sequence
  UDP-glucose 4-epimerase (176-184)
aagaccuggaacgccgugcugcucaga

SEQ ID NO: 74675 - RNA, 30 nt, Artificial Sequence
  UDP-glucose 4-epimerase (176-185)
aagaccuggaacgccgugcugcucagauac

SEQ ID NO: 74676 - RNA, 27 nt, Artificial Sequence
  Transcription factor IIIA (198-206)
aagaccuggacagagcugcucaaacac

SEQ ID NO: 74677 - RNA, 33 nt, Artificial Sequence
  A-kinase anchor protein 8-like (264-274)
aagaccuggacaacugccgacuucagaacgaaa

SEQ ID NO: 74678 - RNA, 33 nt, Artificial Sequence
  Nuclear pore complex protein Nup107 (574-584)
aagaccuacauccagcugcucauuagagagaaa

SEQ ID NO: 74679 - RNA, 27 nt, Artificial Sequence
  Poly(A)-specific ribonuclease PARN-like domain-containing protein 1 (364-372)
aagguggcccaccugcuccuucagaaa

SEQ ID NO: 74680 - RNA, 33 nt, Artificial Sequence
  Mesoderm development candidate 1 (236-246)
aagguggcccccagcgagcuggcuagauccagg

SEQ ID NO: 74681 - RNA, 33 nt, Artificial Sequence
  Calponin-3 (251-261)
aagguggccagccagaaaggcauguccgucuac

SEQ ID NO: 74682 - RNA, 27 nt, Artificial Sequence
  Trafficking protein particle complex subunit 11 (134-142)
aagguggccgucguucugauccagaaa

SEQ ID NO: 74683 - RNA, 27 nt, Artificial Sequence
  Poly(A) polymerase gamma (590-598)
aagguggacagcaccgucaaaacaguu

SEQ ID NO: 74684 - RNA, 36 nt, Artificial Sequence
  Actin-related protein 2/3 complex subunit 3 (147-158)
aagguguucgacccccagaacgauaaaccuagcaag

SEQ ID NO: 74685 - RNA, 36 nt, Artificial Sequence
  Myosin regulatory light chain 10 (142-153)
aagguguucgacaccgagggcaaaggguuugucaag

SEQ ID NO: 74686 - RNA, 27 nt, Artificial Sequence
  AP-2 complex subunit mu (405-413)
aagguguucgagcccaaacugaacuac

SEQ ID NO: 74687 - RNA, 27 nt, Artificial Sequence
  Lysine-specific histone demethylase 1A (228-236)
aagguguuccuguuuaucagaaacagg

SEQ ID NO: 74688 - RNA, 27 nt, Artificial Sequence
  Serine/threonine-protein phosphatase 2A activator (141-149)
aagguguucaacagauaccuggagguc

SEQ ID NO: 74689 - RNA, 27 nt, Artificial Sequence
  Long-chain-fatty-acid-CoA ligase 3 (90-98)
aagguguucaccuacgccaaaaacaag

SEQ ID NO: 74690 - RNA, 27 nt, Artificial Sequence
  Caspase-2 (77-85)
aaggugggcagcuucucccagaacguc

SEQ ID NO: 74691 - RNA, 27 nt, Artificial Sequence
  Syntaxin-binding protein 1 (125-133)
aaggugaucaaaacccugacagagauu

SEQ ID NO: 74692 - RNA, 33 nt, Artificial Sequence
  Zinc finger protein 721 (244-254)
aaggugaucagcuccucuucaaguuucgccaaa

SEQ ID NO: 74693 - RNA, 30 nt, Artificial Sequence
  Protein kinase C delta type (353-362)
aaggugcugggcaaagggagcuucggaaag

SEQ ID NO: 74694 - RNA, 36 nt, Artificial Sequence
  Inositol 1,4,5-trisphosphate receptor type 1 (451-462)
aaggugcugggcagcaucgccgggaaacucgagaag

SEQ ID NO: 74695 - RNA, 33 nt, Artificial Sequence
  Nuclease-sensitive element-binding protein 1 (58-68)
aaggugcugggcaccgucaaaugguucaacguu

SEQ ID NO: 74696 - RNA, 27 nt, Artificial Sequence
  SLIT-ROBO Rho GTPase-activating protein 1 (156-164)
aaggugcugaacgagcucuacaccguc

SEQ ID NO: 74697 - RNA, 33 nt, Artificial Sequence
  Trafficking protein particle complex subunit 11 (54-64)
aaggugcugcccggcgaccacgaguacccuaaa

SEQ ID NO: 74698 - RNA, 33 nt, Artificial Sequence
  B-cell CLL/lymphoma 7 protein family member B (20-30)
aaggugauggccgcuaucgagaaagucagaaag

SEQ ID NO: 74699 - RNA, 27 nt, Artificial Sequence
  Uncharacterized protein C10orf88 (295-303)
aaggugaugccccagaaccacagcuuc

SEQ ID NO: 74700 - RNA, 27 nt, Artificial Sequence
  Max-like protein X (158-166)
aaggugaacuacgagcagaucgucaaa

SEQ ID NO: 74701 - RNA, 27 nt, Artificial Sequence
  Mitochondrial antiviral-signaling protein (311-319)
aaggugcccgccaacccugcuagcguc

SEQ ID NO: 74702 - RNA, 30 nt, Artificial Sequence
  Guanine nucleotide-binding protein G(s) subunit alpha isoforms short (77-86)
aaggugcaggacaucaaaaacaaucugaag

SEQ ID NO: 74703 - RNA, 30 nt, Artificial Sequence
  Kinectin (324-333)
aaggugcaggagcugcaaaaccuccuuaaa

SEQ ID NO: 74704 - RNA, 27 nt, Artificial Sequence
  Centromere protein F (2787-2795)
aaggugagagaggaaaucgccgaguac

SEQ ID NO: 74705 - RNA, 27 nt, Artificial Sequence
  Transcription elongation factor SPT6 (191-199)
aaggugagcgacggcaucuaccagcac

SEQ ID NO: 74706 - RNA, 27 nt, Artificial Sequence
  Peptidyl-prolyl cis-trans isomerase FKBP3 (80-88)
aaggugagcgagcaggucaaaaacguu

SEQ ID NO: 74707 - RNA, 27 nt, Artificial Sequence
  Exocyst complex component 7 (506-514)
aaggugaccgacuacaucgccgagaaa

SEQ ID NO: 74708 - RNA, 27 nt, Artificial Sequence
  39S ribosomal protein L51, mitochondrial (1-9)
aagguggucgacagauggaacgagaaa

SEQ ID NO: 74709 - RNA, 27 nt, Artificial Sequence
  Zinc finger CCHC-type and RNA-binding motif-containing protein 1 (35-43)
aagguggucaaaguuaccaucaugaag

SEQ ID NO: 74710 - RNA, 27 nt, Artificial Sequence
  Liprin-beta-1 (756-764)
aagguggucagcguucugcaccaucuc

SEQ ID NO: 74711 - RNA, 27 nt, Artificial Sequence
  Pre-mRNA-splicing factor SPF27 (136-144)
aagguguacaacgagaaucugguccac

SEQ ID NO: 74712 - RNA, 27 nt, Artificial Sequence
  Extended synaptotagmin-2 (225-233)
aagguguacaccgagaacgucgacaaa

SEQ ID NO: 74713 - RNA, 27 nt, Artificial Sequence
  DNA helicase MCM8 (563-571)
aaguacaucggcuaugccagacaguac

SEQ ID NO: 74714 - RNA, 27 nt, Artificial Sequence
  Ubiquitin-associated protein 2-like (970-978)
aaguaccccccuccauauaaacacuuc

SEQ ID NO: 74715 - RNA, 27 nt, Artificial Sequence
  Fc receptor-like protein 3 (587-595)
cuggccgcugcagccgcgcuccuucac

SEQ ID NO: 74716 - RNA, 30 nt, Artificial Sequence
  Nucleosome assembly protein 1-like 1 (320-329)
cuggccgcugacuucgagaucggccacuuu

SEQ ID NO: 74717 - RNA, 27 nt, Artificial Sequence
  Lanosterol 14-alpha demethylase (46-54)
cuggccgcuggccaccucgugcagcuu

SEQ ID NO: 74718 - RNA, 24 nt, Artificial Sequence
  KIAA1751 protein (14-21)
cuggccgacgcucuccuucuggag

SEQ ID NO: 74719 - RNA, 27 nt, Artificial Sequence
  Tripartite motif-containing protein 35 (187-195)
cuggccgacgagaagaugaaacagcuc

SEQ ID NO: 74720 - RNA, 27 nt, Artificial Sequence
  Rho GTPase-activating protein 11B (163-171)
cuggccgaccacaccgugcauguccuc

SEQ ID NO: 74721 - RNA, 30 nt, Artificial Sequence
  Annexin A1 (198-207)
cuggccgacagcgaugcuagagcacucuac

SEQ ID NO: 74722 - RNA, 33 nt, Artificial Sequence
  Macrophage migration inhibitory factor (82-92)
cuggccgagagacucaggaucagccccgaccgg

SEQ ID NO: 74723 - RNA, 27 nt, Artificial Sequence
  MICOS complex subunit MIC10 (43-51)
cuggccuucggcagcgggaugggacuc

SEQ ID NO: 74724 - RNA, 27 nt, Artificial Sequence
  Dedicator of cytokinesis protein 11 (1003-1011)
cuggccaucauuccccacgugaccaua

SEQ ID NO: 74725 - RNA, 33 nt, Artificial Sequence
  Thioredoxin domain-containing protein 15 (243-253)
cuggcccucgacgcuagccagcacuccucucuu

SEQ ID NO: 74726 - RNA, 27 nt, Artificial Sequence
  Ribosomal protein S6 kinase alpha-2 (72-80)
cuggcccucgaccaccuucauagccug

SEQ ID NO: 74727 - RNA, 27 nt, Artificial Sequence
  Breast cancer type 2 susceptibility protein (901-909)
cuggcccucggcaacaccaaggagcuu

SEQ ID NO: 74728 - RNA, 27 nt, Artificial Sequence
  Dual specificity protein phosphatase 3 (113-121)
cuggcccagaagaacggcagagugcuc

SEQ ID NO: 74729 - RNA, 27 nt, Artificial Sequence
  Transmembrane protein 8A (26-34)
cuggccagacccccuccagcuagcgca

SEQ ID NO: 74730 - RNA, 36 nt, Artificial Sequence
  Serine protease 56 (350-361)
cuggccugggaccccccucaggagcuccaagcugau

SEQ ID NO: 74731 - RNA, 30 nt, Artificial Sequence
  Vacuolar protein sorting-associated protein 13B (3150-3159)
cuggacgccagccuccuucagaagcaaauc

SEQ ID NO: 74732 - RNA, 39 nt, Artificial Sequence
  Zinc finger protein castor homolog 1 (1616-1628)
cuggacggcagccucucccuuggggccgagcccggaucu

SEQ ID NO: 74733 - RNA, 27 nt, Artificial Sequence
  Connector enhancer of kinase suppressor of ras 3 (161-169)
cuggaccucaccacaacugugcagaag

SEQ ID NO: 74734 - RNA, 30 nt, Artificial Sequence
  Coiled-coil domain-containing protein 66 (308-317)
cuggaccagagcagagagaccgugcuccuu

SEQ ID NO: 74735 - RNA, 33 nt, Artificial Sequence
  Protein S100-A9 (66-76)
cuggacaccaacgccgauaagcagcucagcuuc

SEQ ID NO: 74736 - RNA, 27 nt, Artificial Sequence
  Uveal autoantigen with coiled-coil domains and ankyrin repeats (769-777)
cuggacgugacccagaaguacacagag

SEQ ID NO: 74737 - RNA, 27 nt, Artificial Sequence
  Actin-binding LIM protein 1 (304-312)
cuggacuacaaggaucucgccgcuauc

SEQ ID NO: 74738 - RNA, 30 nt, Artificial Sequence
  Uncharacterized protein (163-172)
cuggaggaauacaacaagauccuccuugac

SEQ ID NO: 74739 - RNA, 30 nt, Artificial Sequence
  Tyrosinase (279-288)
cuggaggaauacaacagccaccagucccuc

SEQ ID NO: 74740 - RNA, 30 nt, Artificial Sequence
  Vimentin (404-413)
cuggagggcgaagagagcagaaucucccuc

SEQ ID NO: 74741 - RNA, 51 nt, Artificial Sequence
  Keratin, type I cytoskeletal 10 (257-273)
cuggagggcgaagggagcuccggagguggcgggagaggaggcgguucuuuc

SEQ ID NO: 74742 - RNA, 30 nt, Artificial Sequence
  Eukaryotic translation initiation factor 3 subunit M (232-241)
cuggagggcgaacucauccacgaccuucug

SEQ ID NO: 74743 - RNA, 27 nt, Artificial Sequence
  Nestin (589-597)
cuggagaaggaaaacaaagagcuccuu

SEQ ID NO: 74744 - RNA, 33 nt, Artificial Sequence
  Protein FAM167B (131-141)
cuggagcucgaacccggcgccgggcuugcucug

SEQ ID NO: 74745 - RNA, 27 nt, Artificial Sequence
  Nestin (560-568)
cuggagaaccagagccacgaaacccuc

SEQ ID NO: 74746 - RNA, 30 nt, Artificial Sequence
  Alpha-actinin-4 (707-716)
cuggagcagcaacaccagcucauccaggaa

SEQ ID NO: 74747 - RNA, 33 nt, Artificial Sequence
  Ribosomal protein S6 kinase delta-1 (1025-1035)
cuggagagacucggcgccgggguggcuggaguc

SEQ ID NO: 74748 - RNA, 27 nt, Artificial Sequence
  Coiled-coil domain-containing protein 77 (409-417)
cuggagagaaggcggauccucgaagug

SEQ ID NO: 74749 - RNA, 27 nt, Artificial Sequence
  Hydrocephalus-inducing protein homolog (151-159)
cuguucgaccacgugaccgagagagaa

SEQ ID NO: 74750 - RNA, 21 nt, Artificial Sequence
  Nucleoredoxin (9-15)
cugggcgagaagcucgugacc

SEQ ID NO: 74751 - RNA, 39 nt, Artificial Sequence; identical to SEQ ID NO: 50524
  Protein S100-A9 (26-38)

SEQ ID NO: 74752 - RNA, 27 nt, Artificial Sequence
  Serine beta-lactamase-like protein LACTB, mitochondrial (52-60)
cugggcgugaagcucgccgggggacuu

SEQ ID NO: 74753 - RNA, 33 nt, Artificial Sequence
  Galectin-1 (43-53)
cugcacuucaaccccagauuuaaugcccauggc

SEQ ID NO: 74754 - RNA, 30 nt, Artificial Sequence
  Translocon-associated protein subunit gamma (176-185)
cugaucgcccuccuuagcaccggcuccaag

SEQ ID NO: 74755 - RNA, 30 nt, Artificial Sequence
  Alpha-actinin-4 (718-727)
cugaucuucgacaacaagcacaccaauuac

SEQ ID NO: 74756 - RNA, 30 nt, Artificial Sequence
  Solute carrier family 40 member 1 (135-144)
cugaucauuaccauagccaacaucgcuaau

SEQ ID NO: 74757 - RNA, 33 nt, Artificial Sequence
  Prohibitin (163-173)
cugauccucgacgaugugagccuuacccaccug

SEQ ID NO: 74758 - RNA, 30 nt, Artificial Sequence
  Lysosomal-associated transmembrane protein 4B (214-223)
cugaucuaccccaacagcauucaggaguau

SEQ ID NO: 74759 - RNA, 27 nt, Artificial Sequence
  Desmoplakin (486-494)
cugaaggagcaggccaucaaaauuacc

SEQ ID NO: 74760 - RNA, 27 nt, Artificial Sequence
  Histone deacetylase complex subunit SAP30L (60-68)
cugaagcucgacaucgauaaaagccuu

SEQ ID NO: 74761 - RNA, 30 nt, Artificial Sequence
  Lipoxygenase homology domain-containing protein 1 (933-942)
cugaagagcuccaaaaccaacucugacaag

SEQ ID NO: 74762 - RNA, 27 nt, Artificial Sequence
  Alpha-1-antichymotrypsin (12-20)
cugcucgccgcuggcuucugccccgca

SEQ ID NO: 74763 - RNA, 33 nt, Artificial Sequence
  Granulocyte-macrophage colony-stimulating factor receptor subunit alpha (9-19)
cugcucugcgagcuuccccacccugccuuccug

SEQ ID NO: 74764 - RNA, 27 nt, Artificial Sequence
  Probable serine carboxypeptidase CPVL (258-266)
cugcucgacgagaagcagaaaaaguac

SEQ ID NO: 74765 - RNA, 27 nt, Artificial Sequence
  Teashirt homolog 3 (435-443)
cugcucgacgagaaggugcagagcguc

SEQ ID NO: 74766 - RNA, 27 nt, Artificial Sequence
  Alpha-aminoadipic semialdehyde synthase, mitochondrial (668-676)
cugcucgacggcaagguggucaacguu

SEQ ID NO: 74767 - RNA, 27 nt, Artificial Sequence
  Catenin delta-1 (315-323)
cugcucgaccaccccaagaaagaggug

SEQ ID NO: 74768 - RNA, 27 nt, Artificial Sequence
  Interleukin-13 receptor subunit alpha-2 (164-172)
cugcucgacaccaacuacaaucuuuuc

SEQ ID NO: 74769 - RNA, 30 nt, Artificial Sequence
  Interleukin-13 receptor subunit alpha-2 (164-173)
cugcucgacaccaacuacaaucuuuucuau

SEQ ID NO: 74770 - RNA, 30 nt, Artificial Sequence
  RAD50-interacting protein 1 (435-444)
cugcucuucgagagagaacuucacagcgug

SEQ ID NO: 74771 - RNA, 39 nt, Artificial Sequence
  Sorting nexin-21 (131-143)
cugcucuucgaggugaccagcgccaacgucguuaaggac

SEQ ID NO: 74772 - RNA, 27 nt, Artificial Sequence
  Complement decay-accelerating factor (14-22)
cugcucggcgagcuucccagacuguug

SEQ ID NO: 74773 - RNA, 27 nt, Artificial Sequence
  Torsin-1A-interacting protein 2, isoform IFRG15 (90-98)
cugcucggccccccucuugugagaaag

SEQ ID NO: 74774 - RNA, 33 nt, Artificial Sequence
  Collagen alpha-1(IV) chain (17-27)
cugcuccacgaggaacauagcagagccgcugca

SEQ ID NO: 74775 - RNA, 27 nt, Artificial Sequence
  Pescadillo homolog (73-81)
cugcuccacgagcccaucgugaacaag

SEQ ID NO: 74776 - RNA, 24 nt, Artificial Sequence
  DST protein (851-858)
cugcucaaggacaaacuugaugag

SEQ ID NO: 74777 - RNA, 27 nt, Artificial Sequence
  Inverted formin-2 (76-84)
cugcuccuugaggcccuggcuagauug

SEQ ID NO: 74778 - RNA, 33 nt, Artificial Sequence
  Metastasis suppressor protein 1 (174-184)
cugcuccuugaggaaaccgagaagcaggccgug

SEQ ID NO: 74779 - RNA, 33 nt, Artificial Sequence
  Signal transducer and activator of transcription 6 (550-560)
cugcuccuuaacgagcccgacggcaccuuccug

SEQ ID NO: 74780 - RNA, 27 nt, Artificial Sequence
  Carboxypeptidase N catalytic chain (379-387)
cugcuccuucccggcaucuacaccgug

SEQ ID NO: 74781 - RNA, 27 nt, Artificial Sequence
  KATNB1-like protein 1 (135-143)
cugcucagaaacauccagauucuuaag

SEQ ID NO: 74782 - RNA, 27 nt, Artificial Sequence
  Zinc finger protein ubi-d4 (122-130)
cugcucagaaccgacccccuugagaag

SEQ ID NO: 74783 - RNA, 33 nt, Artificial Sequence; identical to SEQ ID NO: 50556
  Cytoplasmic dynein 1 heavy chain 1 (2160-2170)

SEQ ID NO: 74784 - RNA, 33 nt, Artificial Sequence
  Aspartate beta-hydroxylase domain-containing protein 1 (342-352)
cugcucguggacgauagcuuccuucacaccguc

SEQ ID NO: 74785 - RNA, 33 nt, Artificial Sequence
  Lon protease homolog 2, peroxisomal (173-183)
cugcucgugagacagaucgagggccuuaagcug

SEQ ID NO: 74786 - RNA, 30 nt, Artificial Sequence
  Growth hormone-inducible transmembrane protein (291-300)
cugcucuacgacacccagaaggugaucaaa

SEQ ID NO: 74787 - RNA, 27 nt, Artificial Sequence
  Integrin alpha-7 (875-883)
cugcucuaccccaugcagguggagcuu

SEQ ID NO: 74788 - RNA, 33 nt, Artificial Sequence
  Protein FAM69B (179-189)
cugauggccgacuucaacaaggauaauagagug

SEQ ID NO: 74789 - RNA, 27 nt, Artificial Sequence
  Pre-mRNA-processing factor 6 (250-258)
cugauggacaugagacucagccaggug

SEQ ID NO: 74790 - RNA, 27 nt, Artificial Sequence
  L-dopachrome tautomerase (194-202)
cugauggagacccaccucagcuccaag

SEQ ID NO: 74791 - RNA, 27 nt, Artificial Sequence
  Hippocampus abundant transcript-like protein 1 (59-67)
cugaugaacggccucauccagggggug

SEQ ID NO: 74792 - RNA, 36 nt, Artificial Sequence
  Vimentin (413-424)
cugccccucccuaacuucagcucccuuaaucugaga

SEQ ID NO: 74793 - RNA, 30 nt, Artificial Sequence
  Vimentin (431-440)
cugccccucguggacacccacagcaagaga

SEQ ID NO: 74794 - RNA, 27 nt, Artificial Sequence
  Ectonucleotide pyrophosphatase/phosphodiesterase family member 1 (605-613)
cugcccuacggcagaccuagggugcuc

SEQ ID NO: 74795 - RNA, 30 nt, Artificial Sequence
  Eukaryotic translation initiation factor 5A-1 (102-111)
cugcaggacagcggcgaggugagagaagau

SEQ ID NO: 74796 - RNA, 27 nt, Artificial Sequence
  Coiled-coil domain-containing protein 13 (338-346)
cugcagagagagcucgaagagcuuaag

SEQ ID NO: 74797 - RNA, 27 nt, Artificial Sequence
  Zinc finger protein 703 (534-542)
cugagaaacccccacacccucggccuu

SEQ ID NO: 74798 - RNA, 30 nt, Artificial Sequence
  ATP-binding cassette sub-family A member 13 (39-48)
cugagcgccauccagggcgugacccucgcu

SEQ ID NO: 74799 - RNA, 33 nt, Artificial Sequence
  GPI-anchor transamidase (151-161)
cugagcgacgauagauccaacauccucauuuac

SEQ ID NO: 74800 - RNA, 27 nt, Artificial Sequence
  General transcription factor 3C polypeptide 2 (596-604)
cugagcgacggcucccucaagcuuuac

SEQ ID NO: 74801 - RNA, 27 nt, Artificial Sequence
  Myotubularin-related protein 5 (501-509)
cugagcgaccccuucuacagaacccuc

SEQ ID NO: 74802 - RNA, 27 nt, Artificial Sequence
  Low affinity immunoglobulin gamma Fc region receptor II-b (113-121)
cugagcgaccccgugcaccucaccguc

SEQ ID NO: 74803 - RNA, 27 nt, Artificial Sequence
  Tyrosine-protein kinase JAK1 (30-38)
cugagcgacagagagccccucaggcuu

SEQ ID NO: 74804 - RNA, 27 nt, Artificial Sequence
  Exportin-5 (689-697)
cugagcgacguggaugccuucaucgcu

SEQ ID NO: 74805 - RNA, 33 nt, Artificial Sequence
  DNA polymerase zeta catalytic subunit (2423-2433)
cugagcgacugguucgauaacaagaccgaccuc

SEQ ID NO: 74806 - RNA, 27 nt, Artificial Sequence
  Little elongation complex subunit 1 (1975-1983)
cugagcgagcucaagauccagaaaauu

SEQ ID NO: 74807 - RNA, 33 nt, Artificial Sequence
  Cell surfaceoprotein MUC18 (332-342)
cugagcgagccccaggaacuccuugugaacuac

SEQ ID NO: 74808 - RNA, 27 nt, Artificial Sequence
  Putative stereocilin-like protein (36-44)
cugagcuuccucaagucccuucugucu

SEQ ID NO: 74809 - RNA, 27 nt, Artificial Sequence
  Melanocyte protein PMEL (177-185)
cugagcaucggcaccgggagagccaug

SEQ ID NO: 74810 - RNA, 27 nt, Artificial Sequence
  Cytoplasmic dynein 1 heavy chain 1 (746-754)
cugagcaaggaggugagaaaccucaaa

SEQ ID NO: 74811 - RNA, 27 nt, Artificial Sequence
  Exophilin-5 (986-994)
cugagcaagaccgaguccaucucugug

SEQ ID NO: 74812 - RNA, 30 nt, Artificial Sequence
  EF-hand calcium-binding domain-containing protein 6 (344-353)
cugagccuccccacccaggagcuuagaccu

SEQ ID NO: 74813 - RNA, 27 nt, Artificial Sequence
  Methylcrotonoyl-CoA carboxylase subunit alpha, mitochondrial (108-116)
cugagcauggagaagaucauucaggug

SEQ ID NO: 74814 - RNA, 33 nt, Artificial Sequence
  Zinc finger and BTB domain-containing protein 34 (63-73)
cugagcaccauguccggccucucuaucucagug

SEQ ID NO: 74815 - RNA, 27 nt, Artificial Sequence
  Vacuolar protein sorting-associated protein 13B (1713-1721)
cugagcguggcccagguccaacuccuu

SEQ ID NO: 74816 - RNA, 27 nt, Artificial Sequence
  PERQ amino acid-rich with GYF domain-containing protein 1 (92-100)
cugagcgugaacuccgucgccguucuc

SEQ ID NO: 74817 - RNA, 33 nt, Artificial Sequence
  Mitogen-activated protein kinase 14 (122-132)
cugaccgacgaucacgugcaguuccucaucuac

SEQ ID NO: 74818 - RNA, 33 nt, Artificial Sequence
  FAST kinase domain-containing protein 5 (625-635)
cugaccgacgaucucaugaacaagcuucugaaa

SEQ ID NO: 74819 - RNA, 33 nt, Artificial Sequence
  Vacuolar protein sorting-associated protein VTA1 homolog (134-144)
cugaccgacgagaacgugaagcacagaaaauac

SEQ ID NO: 74820 - RNA, 30 nt, Artificial Sequence
  Ectonucleoside triphosphate diphosphohydrolase 4 (199-208)
cugaccgacauccccgugcacuucgauuuu

SEQ ID NO: 74821 - RNA, 21 nt, Artificial Sequence
  39S ribosomal protein L52, mitochondrial (43-49)
cugaccgagcuccccgacugg

SEQ ID NO: 74822 - RNA, 30 nt, Artificial Sequence
  Glutathione S-transferase theta-1 (64-73)
cugaccgagagcguggccauccuccuuuac

SEQ ID NO: 74823 - RNA, 27 nt, Artificial Sequence
  AFG3-like protein 2 (346-354)
cugaccggccccccugggacaggaaag

SEQ ID NO: 74824 - RNA, 21 nt, Artificial Sequence
  Keratin, type I cytoskeletal 9 (86-92)
cugaccaagacacucaacgac

SEQ ID NO: 74825 - RNA, 33 nt, Artificial Sequence
  Amphoterin-induced protein 1 (187-197)
cugacccuccuugaccugagcuccaacaaguug

SEQ ID NO: 74826 - RNA, 27 nt, Artificial Sequence
  Delta and Notch-like epidermal growth factor-related receptor (632-640)
cugaccaacaugcccagacacagccuc

SEQ ID NO: 74827 - RNA, 36 nt, Artificial Sequence
  Synaptosomal-associated protein 23 (156-167)
cugacccaggugggcagcauccucgggaaccuuaag

SEQ ID NO: 74828 - RNA, 33 nt, Artificial Sequence
  Inactive rhomboid protein 2 (165-175)
cugaccagcuucacauccgugagaucuggcuac

SEQ ID NO: 74829 - RNA, 27 nt, Artificial Sequence
  Tubulin beta-4B chain (273-281)
cugaccagcagaggcucccagcaauac

SEQ ID NO: 74830 - RNA, 27 nt, Artificial Sequence
  Tectonic-3 (319-327)
cugaccguggagcccggcgccagccuc

SEQ ID NO: 74831 - RNA, 30 nt, Artificial Sequence
  LON peptidase N-terminal domain and RING finger protein 1 (764-773)
cugaccuacuucagcagagaccaguccaag

SEQ ID NO: 74832 - RNA, 45 nt, Artificial Sequence
  60S ribosomal protein L34 (5-19)
cugaccuacagaaggcggcucagcuauaacacagccuccaauaag

SEQ ID NO: 74833 - RNA, 30 nt, Artificial Sequence
  Aspartate beta-hydroxylase domain-containing protein 1 (343-352)
cugguggacgauagcuuccuccacaccguc

SEQ ID NO: 74834 - RNA, 24 nt, Artificial Sequence
  Cytosolic non-specific dipeptidase (250-257)
cugguggacaagagaggcaacauc

SEQ ID NO: 74835 - RNA, 30 nt, Artificial Sequence
  Thymidine phosphorylase (223-232)
cugguggagggccucagcgcccuugucguu

SEQ ID NO: 74836 - RNA, 27 nt, Artificial Sequence
  Matrin-3 (461-469)
cugguguucggcaagcccgucagaguu

SEQ ID NO: 74837 - RNA, 33 nt, Artificial Sequence; identical to SEQ ID NO: 50610
  POTE ankyrin domain family member F (708-718)

SEQ ID NO: 74838 - RNA, 33 nt, Artificial Sequence; identical to SEQ ID NO: 50611
  Phospholipid hydroperoxide glutathione peroxidase, mitochondrial (187-197)

SEQ ID NO: 74839 - RNA, 33 nt, Artificial Sequence
  Roquin-2 (100-110)
cuggugaucgagagcauucccguccucggcacc

SEQ ID NO: 74840 - RNA, 27 nt, Artificial Sequence
  Probable ATP-dependent RNA helicase DDX17 (248-256)
cuggugcucgcccccaccagagagcuu

SEQ ID NO: 74841 - RNA, 27 nt, Artificial Sequence
  Melanocyte protein PMEL (10-18)
cuggugcucaagagaugccuucugcac

SEQ ID NO: 74842 - RNA, 39 nt, Artificial Sequence
  Beta-actin-like protein 2 (9-21)
cugguggucgacaacggcagcgggaugugcaaggccgga

SEQ ID NO: 74843 - RNA, 27 nt, Artificial Sequence
  DNA mismatch repair protein Msh6 (111-119)
cuguacagccaggccggccuccuugcu

SEQ ID NO: 74844 - RNA, 33 nt, Artificial Sequence
  Olfactory receptor 4M2 (122-132)
cuguacaccgccaucugcagaccccuccacuau

SEQ ID NO: 74845 - RNA, 39 nt, Artificial Sequence
  Heterogeneous nuclear ribonucleoprotein L (35-47)
auggccgcugcaggcgggggagguggcgggggaagauac

SEQ ID NO: 74846 - RNA, 30 nt, Artificial Sequence
  Exocyst complex component 4 (1-10)
auggccgcugaggcagccggcgggaaguac

SEQ ID NO: 74847 - RNA, 27 nt, Artificial Sequence
  Liprin-alpha-1 (538-546)
auggccgacggccacaccgauagcuac

SEQ ID NO: 74848 - RNA, 27 nt, Artificial Sequence
  Cystatin-C (1-9)
auggccggcccccugagagcuccucuc

SEQ ID NO: 74849 - RNA, 30 nt, Artificial Sequence
  WD repeat-containing protein 7 (1479-1488)
auggcccacgacggcaaggagcauagauuc

SEQ ID NO: 74850 - RNA, 33 nt, Artificial Sequence
  WD repeat-containing protein 7 (1479-1489)
auggcccacgacggcaaggagcauagauucaug

SEQ ID NO: 74851 - RNA, 27 nt, Artificial Sequence
  Tubulin polyglutamylase complex subunit 2 (33-41)
auggccaucaacagcauuuccaagcug

SEQ ID NO: 74852 - RNA, 33 nt, Artificial Sequence
  Intron-binding protein aquarius (867-877)
auggcccuggacaucgaugagagacaccuccuu

SEQ ID NO: 74853 - RNA, 33 nt, Artificial Sequence
  Ribonuclease pancreatic (1-11)
auggcccuggagaagagccucgugagacuucug

SEQ ID NO: 74854 - RNA, 36 nt, Artificial Sequence
  Actin, cytoplasmic 2 (18-29)
auggccaccgcugcaagcuccucuucacuggagaag

SEQ ID NO: 74855 - RNA, 27 nt, Artificial Sequence
  STE20-related kinase adapter protein alpha (113-121)
auggccuacggcagcgcuaaggaccug

SEQ ID NO: 74856 - RNA, 30 nt, Artificial Sequence
  High mobility group protein 20A (131-140)
auggaguucgaagagagaaacgccgcucug

SEQ ID NO: 74857 - RNA, 33 nt, Artificial Sequence
  Squalene synthase (112-122)
auggagagcaaggaaaaagacagacaggugcug

SEQ ID NO: 74858 - RNA, 27 nt, Artificial Sequence
  A-kinase anchor protein 11 (545-553)
augaucaaggacagcauucagaaauuc

SEQ ID NO: 74859 - RNA, 27 nt, Artificial Sequence
  Protein mago nashi homolog (45-53)
augaucagaaaggaggaacuggagauu

SEQ ID NO: 74860 - RNA, 30 nt, Artificial Sequence
  Hypoxia-inducible factor 1-alpha (109-118)
augaucuacauuagcgacaacgugaauaag

SEQ ID NO: 74861 - RNA, 33 nt, Artificial Sequence
  Nidogen-1 (1-11)
augcuggccagcuccucuagaaucagggcugca

SEQ ID NO: 74862 - RNA, 33 nt, Artificial Sequence
  Spectrin beta chain, non-erythrocytic 1 (1424-1434)
augcuggagaaccagauggaagugagaaagaaa

SEQ ID NO: 74863 - RNA, 33 nt, Artificial Sequence
  Prostate tumor-overexpressed gene 1 protein (184-194)
augcuguucccccacaucagcccuugcgaggug

SEQ ID NO: 74864 - RNA, 27 nt, Artificial Sequence
  Melanoma-associated antigen D2 (305-313)
augcugaaggacaucauuaaagaguac

SEQ ID NO: 74865 - RNA, 33 nt, Artificial Sequence
  DNA-directed RNA polymerases I, II, and III subunit RPABC5 (48-58)
augcugcucgcccacguggaccuuaucgagaag

SEQ ID NO: 74866 - RNA, 30 nt, Artificial Sequence
  Coatomer subunit gamma-1 (404-413)
augcugagagaggaaggcggguucgaguac

SEQ ID NO: 74867 - RNA, 27 nt, Artificial Sequence
  G-protein coupled receptor 143 (175-183)
augcuguacuaucccagcguguccaga

SEQ ID NO: 74868 - RNA, 54 nt, Artificial Sequence
  G-protein coupled receptor 143 (175-192)
augcuguacuaucccagcguguccagaaagcuccuugaguacaucgaagagauu

SEQ ID NO: 74869 - RNA, 36 nt, Artificial Sequence
  LIM domain and actin-binding protein 1 (101-112)
augauguucgagaagggcgaacccacccagacaaaa

SEQ ID NO: 74870 - RNA, 24 nt, Artificial Sequence
  T-complex protein 1 subunit eta (172-179)
augaugcuggacgaucuccuucag

SEQ ID NO: 74871 - RNA, 27 nt, Artificial Sequence
  Neuroblast differentiation-associated protein AHNAK (2771-2779)
augcccaagaucagcaugccuggcuuc

SEQ ID NO: 74872 - RNA, 27 nt, Artificial Sequence
  Neuroblast differentiation-associated protein AHNAK (749-757)
augcccaagaugaaaaugccuaaguuc

SEQ ID NO: 74873 - RNA, 27 nt, Artificial Sequence
  Neuroblast differentiation-associated protein AHNAK (1382-1390)
augcccaaggugaaaaugccuaaguuc

SEQ ID NO: 74874 - RNA, 24 nt, Artificial Sequence
  ATP-dependent RNA helicase DDX24 (584-591)
augcaguaccccggcagaagccug

SEQ ID NO: 74875 - RNA, 39 nt, Artificial Sequence
  Leucine zipper putative tumor suppressor 1 (179-191)
augagcucccugcccacccacucuacaucaaguagcuac

SEQ ID NO: 74876 - RNA, 27 nt, Artificial Sequence
  Liprin-alpha-1 (1170-1178)
augagcucccccucuaugcagccuaag

SEQ ID NO: 74877 - RNA, 33 nt, Artificial Sequence
  Vimentin (1-11)
augagcaccagauccgugucuucaaguagcuac

SEQ ID NO: 74878 - RNA, 27 nt, Artificial Sequence
  ADP-ribosylation factor-like protein 5B (133-141)
augaccgccgcugagaucagcaaguac

SEQ ID NO: 74879 - RNA, 39 nt, Artificial Sequence
  CD44 antigen (412-424)
augaccgccgacgagacaagaaaccugcagaauguggau

SEQ ID NO: 74880 - RNA, 27 nt, Artificial Sequence
  RNA-binding protein 14 (266-274)
augaccgcccaggcugcaagcuacaga

SEQ ID NO: 74881 - RNA, 42 nt, Artificial Sequence
  TBC1 domain family member 7 (1-14)
augaccgaggacagccagagaaacuucagguccguguacuau

SEQ ID NO: 74882 - RNA, 21 nt, Artificial Sequence
  E3 ubiquitin-protein ligase UBR5 (2723-2729)
augaccgagagacaggaccug

SEQ ID NO: 74883 - RNA, 30 nt, Artificial Sequence
  SEC14-like protein 2 (333-342)
augaccgaggugcugcccaaccagagauac

SEQ ID NO: 74884 - RNA, 27 nt, Artificial Sequence
  Cleavage and polyadenylation specificity factor subunit 3 (99-107)
augacccacgccacaaaggcuaucuac

SEQ ID NO: 74885 - RNA, 30 nt, Artificial Sequence
  Protein phosphatase 1G (151-160)
augaccaucgaggaacugcucacaagauac

SEQ ID NO: 74886 - RNA, 39 nt, Artificial Sequence
  E3 ubiquitin-protein ligase RNF13 (5-17)
augaccagccuggccugggaccccacaacucucagauac

SEQ ID NO: 74887 - RNA, 27 nt, Artificial Sequence
  L-dopachrome tautomerase (30-38)
augaccguggacagccuggucaacaag

SEQ ID NO: 74888 - RNA, 51 nt, Artificial Sequence
  2-oxoisovalerate dehydrogenase subunit alpha, mitochondrial (262-278)
augaccuacagaaucggccaccauagcacauccgacgauucuucagccuau

SEQ ID NO: 74889 - RNA, 30 nt, Artificial Sequence
  Ubiquitin carboxyl-terminal hydrolase 11 (498-507)
augguggccgacgucuucagccacagauuu

SEQ ID NO: 74890 - RNA, 30 nt, Artificial Sequence
  DnaJ homolog subfamily C member 3 (1-10)
augguggcccccggcagcgucaccuccaga

SEQ ID NO: 74891 - RNA, 42 nt, Artificial Sequence
  Proteasome subunit beta type-4 (84-97)
auggugaucgacgaggaacugcucggcgaugggcacagcuac

SEQ ID NO: 74892 - RNA, 24 nt, Artificial Sequence
  Adenylate kinase 9 (1518-1525)
auggugaucuucgagcugagcguc

SEQ ID NO: 74893 - RNA, 33 nt, Artificial Sequence; identical to SEQ ID NO: 50666
  Zinc transporter ZIP6 (217-227)

SEQ ID NO: 74894 - RNA, 27 nt, Artificial Sequence
  Vigilin (427-435)
auggugaaggaccugaucaacagaaug

SEQ ID NO: 74895 - RNA, 27 nt, Artificial Sequence
  Helicase with zinc finger domain 2 (1524-1532)
auggugaaggaguacaugauccaguuc

SEQ ID NO: 74896 - RNA, 27 nt, Artificial Sequence
  Major centromere autoantigen B (13-21)
auggugaagagauaccugaccagcuuc

SEQ ID NO: 74897 - RNA, 51 nt, Artificial Sequence
  ATP synthase subunit e, mitochondrial (1-17)
auggugcccccuguccagguuagcccacugaucaagcucggcagauacucc

SEQ ID NO: 74898 - RNA, 30 nt, Artificial Sequence; identical to SEQ ID NO: 50671
  UV excision repair protein RAD23 homolog B (172-181)

SEQ ID NO: 74899 - RNA, 30 nt, Artificial Sequence
  NGFI-A-binding protein 2 (244-253)
augguggucgagagcguugaaagaaucuuc

SEQ ID NO: 74900 - RNA, 39 nt, Artificial Sequence
  Peptidase inhibitor 15 (91-103)
auggugugggacgagaaccuggccaagagcgcugaagca

SEQ ID NO: 74901 - RNA, 27 nt, Artificial Sequence
  AT-rich interactive domain-containing protein 2 (84-92)
aacgccgcuuucgcacugaagcaguac

SEQ ID NO: 74902 - RNA, 27 nt, Artificial Sequence
  Sphingomyelin phosphodiesterase 4 (248-256)
aacgccgaccccgcuagccacgagauc

SEQ ID NO: 74903 - RNA, 24 nt, Artificial Sequence
  60S ribosomal protein L17 (97-104)
aacgccgagagcaaugcugaacug

SEQ ID NO: 74904 - RNA, 27 nt, Artificial Sequence
  Ethylmalonyl-CoA decarboxylase (70-78)
aacgccuucagcggcgugaugaugcug

SEQ ID NO: 74905 - RNA, 45 nt, Artificial Sequence
  Syndecan-3 (291-305)
aacgccaucgacagcggcuccucugcugcacagcugccccaaaag

SEQ ID NO: 74906 - RNA, 27 nt, Artificial Sequence
  Importin subunit alpha-5 (231-239)
aacgccgugugggcucugagcaaucuc

SEQ ID NO: 74907 - RNA, 30 nt, Artificial Sequence
  EGF domain-specific O-linked N-acetylglucosamine transferase (20-29)
aacgaggcccccccuaauacccacagcauc

SEQ ID NO: 74908 - RNA, 27 nt, Artificial Sequence
  Coatomer subunit beta (113-121)
aacgaguucaucagaggcagcacccug

SEQ ID NO: 74909 - RNA, 33 nt, Artificial Sequence
  Prefoldin subunit 2 (68-78)
aacgaguucagagaaaagcacaauaucaggcug

SEQ ID NO: 74910 - RNA, 27 nt, Artificial Sequence
  GCN1 general control of amino-acid synthesis 1-like 1 (1511-1519)
aacgaguucgugagagacaccgcccug

SEQ ID NO: 74911 - RNA, 30 nt, Artificial Sequence
  Dynamin-like 120 kDa protein, mitochondrial (618-627)
aacgagauccuggacgaagugauuagccuc

SEQ ID NO: 74912 - RNA, 27 nt, Artificial Sequence
  Vimentin (102-110)
aacgagaagguggaacugcaggagcuc

SEQ ID NO: 74913 - RNA, 36 nt, Artificial Sequence
  Keratin, type I cytoskeletal 10 (90-101)
aaccacgaggaagagaugaaggaccugagaaaugug

SEQ ID NO: 74914 - RNA, 36 nt, Artificial Sequence
  Calponin-3 (250-261)
aacaagguggccagccagaaaggcauguccgucuac

SEQ ID NO: 74915 - RNA, 33 nt, Artificial Sequence
  Guanine nucleotide-binding protein-like 3-like protein (343-353)
aaccuggaggaaaucagcaauuacuauggcgug

SEQ ID NO: 74916 - RNA, 33 nt, Artificial Sequence
  Peroxisomal acyl-coenzyme A oxidase 1 (631-641)
aaccuguucgagugggccaagaauagcccccuc

SEQ ID NO: 74917 - RNA, 27 nt, Artificial Sequence
  Galectin-1 (33-41)
aaccugggcaaggacagcaauaaccuc

SEQ ID NO: 74918 - RNA, 33 nt, Artificial Sequence
  Glycogenin-2 (64-74)
aaccugaucgacagcgccgauuacauucaccuc

SEQ ID NO: 74919 - RNA, 36 nt, Artificial Sequence
  Putative ATP-dependent RNA helicase DDX11-like protein 8 (397-408)
aaccugaucgacaccauuacaggcaugcacagcgug

SEQ ID NO: 74920 - RNA, 27 nt, Artificial Sequence
  Glutathione S-transferase Mu 2 (180-188)
aaccugaaggacuucaucagcagauuu

SEQ ID NO: 74921 - RNA, 27 nt, Artificial Sequence
  SAM and SH3 domain-containing protein 1 (646-654)
aaccugaaggagcacaugcccaccuuc

SEQ ID NO: 74922 - RNA, 27 nt, Artificial Sequence
  Abelson tyrosine-protein kinase 2 (353-361)
aaccugcucgacuaccuuagagagugc

SEQ ID NO: 74923 - RNA, 39 nt, Artificial Sequence
  Multidrug resistance-associated protein 7 (339-351)
aaccugcucggcaccgacagcgagagacuucugaauuuc

SEQ ID NO: 74924 - RNA, 30 nt, Artificial Sequence
  Catenin alpha-1 (815-824)
aaccugaugaaugccgugguccagaccguu

SEQ ID NO: 74925 - RNA, 33 nt, Artificial Sequence
  Small glutamine-rich tetratricopeptide repeat-containing protein alpha (236-246)
aaccugaugaauaacccccagauccaacagcuc

SEQ ID NO: 74926 - RNA, 24 nt, Artificial Sequence
  Leucine-rich repeat-containing protein 4C (125-132)
aaccugaauacccucgagcuuuuc

SEQ ID NO: 74927 - RNA, 27 nt, Artificial Sequence
  N-terminal Xaa-Pro-Lys N-methyltransferase 1 (210-218)
aaccugcccgacgagaucuaccacgug

SEQ ID NO: 74928 - RNA, 30 nt, Artificial Sequence
  N-terminal Xaa-Pro-Lys N-methyltransferase 1 (210-219)
aaccugcccgacgagaucuaccacguguau

SEQ ID NO: 74929 - RNA, 27 nt, Artificial Sequence
  DNA repair protein RAD51 homolog 3 (205-213)
aaccugagagaccucgagauccuucug

SEQ ID NO: 74930 - RNA, 27 nt, Artificial Sequence
  MIT domain-containing protein 1 (60-68)
aaccugagagagaagaucagcaaauac

SEQ ID NO: 74931 - RNA, 27 nt, Artificial Sequence
  Negative regulator of reactive oxygen species (622-630)
aaccugagcuccaagaucauuagagug

SEQ ID NO: 74932 - RNA, 33 nt, Artificial Sequence
  Galectin-3-binding protein (51-61)
aaccugugggaccucaccgaugccagcgugguc

SEQ ID NO: 74933 - RNA, 27 nt, Artificial Sequence
  2'-5'-oligoadenylate synthase 3 (990-998)
aacauggccgagggcuucagaaccgug

SEQ ID NO: 74934 - RNA, 27 nt, Artificial Sequence
  X-ray repair cross-complementing protein 5 (410-418)
aacaugcugaaucccccugccgaggug

SEQ ID NO: 74935 - RNA, 27 nt, Artificial Sequence
  Heterogeneous nuclear ribonucleoprotein H (351-359)
aacaugcagcacagauacguggagcug

SEQ ID NO: 74936 - RNA, 27 nt, Artificial Sequence
  Monocarboxylate transporter 7 (86-94)
aacagauucggccacaggcuggugguc

SEQ ID NO: 74937 - RNA, 27 nt, Artificial Sequence
  Leucine-rich repeat-containing protein C10orf11 (190-198)
aacagauucaucagggacgaucagcug

SEQ ID NO: 74938 - RNA, 24 nt, Artificial Sequence
  Proteasome subunit beta type-4 (230-237)
aacagauuccagaucgccaccgug

SEQ ID NO: 74939 - RNA, 27 nt, Artificial Sequence
  Vacuolar protein sorting-associated protein 16 homolog (30-38)
aacagaggcgacuucuuuaugacccug

SEQ ID NO: 74940 - RNA, 27 nt, Artificial Sequence
  Transcription factor MafF (38-46)
aacagacaccugaggggccucagcgcc

SEQ ID NO: 74941 - RNA, 27 nt, Artificial Sequence
  RNA polymerase-associated protein RTF1 homolog (202-210)
aacagaaucgagaagagggaagugcug

SEQ ID NO: 74942 - RNA, 24 nt, Artificial Sequence
  Catenin beta-1 (586-593)
aacagaaucgugauuaggggccug

SEQ ID NO: 74943 - RNA, 27 nt, Artificial Sequence
  Zinc finger and BTB domain-containing protein 38 (384-392)
aacagacuggacaggcacgagcagauc

SEQ ID NO: 74944 - RNA, 27 nt, Artificial Sequence
  40S ribosomal protein S24 (15-23)
aacagacugcuccagaggaagcaaaug

SEQ ID NO: 74945 - RNA, 24 nt, Artificial Sequence
  Cytoplasmic FMR1-interacting protein 1 (839-846)
aacagaaugacccacaagcugcuc

SEQ ID NO: 74946 - RNA, 27 nt, Artificial Sequence
  Transcription initiation factor IIA subunit 2 (54-62)
aacagagugaauuucaggggcagccug

SEQ ID NO: 74947 - RNA, 27 nt, Artificial Sequence
  Pseudouridine-5'-phosphatase (35-43)
aacagauacgacaagaaauauagcugg

SEQ ID NO: 74948 - RNA, 39 nt, Artificial Sequence
  Ribonucleoside-diphosphate reductase large subunit (35-47)
aacagcgccaucauuuacgacagagauuucuccuauaau

SEQ ID NO: 74949 - RNA, 27 nt, Artificial Sequence
  Rho-related BTB domain-containing protein 3 (241-249)
aacagcgaccugaauaaccuccuuuuc

SEQ ID NO: 74950 - RNA, 36 nt, Artificial Sequence
  SAM and SH3 domain-containing protein 1 (424-435)
aacagcgaccccaugggcaaggagggggauuucgug

SEQ ID NO: 74951 - RNA, 39 nt, Artificial Sequence
  SAM and SH3 domain-containing protein 1 (424-436)
aacagcgaccccaugggcaaggagggggauuucguguac

SEQ ID NO: 74952 - RNA, 30 nt, Artificial Sequence
  Schlafen family member 5 (601-610)
aacagcgacagaaaggcccaguccguguac

SEQ ID NO: 74953 - RNA, 33 nt, Artificial Sequence; identical to SEQ ID NO: 50726
  RELT-like protein 1 (113-123)

SEQ ID NO: 74954 - RNA, 33 nt, Artificial Sequence
  Peptidyl-prolyl cis-trans isomerase FKBP9 (143-153)
aacagcgaggaccaggugcaaauccacaccuac

SEQ ID NO: 74955 - RNA, 33 nt, Artificial Sequence
  Zinc finger protein 583 (85-95)
aacagcgaguucuccucuaagcaggaaaccuac

SEQ ID NO: 74956 - RNA, 21 nt, Artificial Sequence
  Thymidylate synthase (205-211)
aacagcgagcuguccugccag

SEQ ID NO: 74957 - RNA, 27 nt, Artificial Sequence
  Zinc finger protein 280D (611-619)
aacaccgcccugagaaaucucagguac

SEQ ID NO: 74958 - RNA, 27 nt, Artificial Sequence
  DNA-directed RNA polymerase III subunit RPC10 (26-34)
aacaccugccccuacgugcacaauauc

SEQ ID NO: 74959 - RNA, 33 nt, Artificial Sequence
  Heterogeneous nuclear ribonucleoprotein L-like (153-163)
aacaccgacgaucccagcggcgggaauaaggug

SEQ ID NO: 74960 - RNA, 30 nt, Artificial Sequence
  Ubiquitin-like protein 5 (19-28)
aacaccgacgauacaaucggcgaccugaag

SEQ ID NO: 74961 - RNA, 27 nt, Artificial Sequence
  Lysosomal-trafficking regulator (2269-2277)
aacaccgacgauugggagaauuucgcc

SEQ ID NO: 74962 - RNA, 27 nt, Artificial Sequence
  Serine/threonine-protein kinase 4 (95-103)
aacaccgaccuguggaucgugauggag

SEQ ID NO: 74963 - RNA, 54 nt, Artificial Sequence
  Selenoprotein O (185-202)
aacaccgacaauaugagcauccugggccucacaauugauuacgggcccuucgga

SEQ ID NO: 74964 - RNA, 30 nt, Artificial Sequence
  DNA-binding protein inhibitor ID-4 (141-150)
aacaccgaccccgccggcgcugugaauaag

SEQ ID NO: 74965 - RNA, 30 nt, Artificial Sequence
  ADP-ribosylation factor-binding protein GGA2 (54-63)
aacaccgaccccaauggcccuacacacgcc

SEQ ID NO: 74966 - RNA, 27 nt, Artificial Sequence
  Phenylalanine-tRNA ligase beta subunit (486-494)
aacaccgacgugggcgccaagaauuac

SEQ ID NO: 74967 - RNA, 27 nt, Artificial Sequence
  Fructose-bisphosphate aldolase A (51-59)
aacaccgaggaaaauagaagguucuac

SEQ ID NO: 74968 - RNA, 27 nt, Artificial Sequence
  Fructose-bisphosphate aldolase C (85-93)
aacaccgaggaaaauagaaggcuguac

SEQ ID NO: 74969 - RNA, 33 nt, Artificial Sequence
  Dynamin-1 (590-600)
aacaccgagcagagaaauguguacaaggacuau

SEQ ID NO: 74970 - RNA, 27 nt, Artificial Sequence
  Neuron navigator 2 (838-846)
aacaccgagagcggcagauacguguau

SEQ ID NO: 74971 - RNA, 27 nt, Artificial Sequence
  WW domain-binding protein 2 (24-32)
aacaccgagagcauccugauguccuac

SEQ ID NO: 74972 - RNA, 33 nt, Artificial Sequence
  Short/branched chain specific acyl-CoA dehydrogenase, mitochondrial (422-432)
aacaccaucgccaagcacauugacgcugaguac

SEQ ID NO: 74973 - RNA, 36 nt, Artificial Sequence
  Mothers against decapentaplegic homolog 2 (91-102)
aacaccaucgaccagugggauacaacuggccuguac

SEQ ID NO: 74974 - RNA, 36 nt, Artificial Sequence
  CDK5 and ABL1 enzyme substrate 1 (7-18)
aacaccaucgacagcacauccucuuucucacaguuu

SEQ ID NO: 74975 - RNA, 27 nt, Artificial Sequence
  H(+)/Cl(-) exchange transporter 5 (18-26)
aacaccaucgacugggugagagagaag

SEQ ID NO: 74976 - RNA, 27 nt, Artificial Sequence
  Coiled-coil domain-containing protein 93 (523-531)
aacacccuggacgauaagaaaguguac

SEQ ID NO: 74977 - RNA, 27 nt, Artificial Sequence
  COP9 signalosome complex subunit 6 (300-308)
aacaccaugaaucaguucgugaacaag

SEQ ID NO: 74978 - RNA, 27 nt, Artificial Sequence
  Protein FAM50A (156-164)
aacaccaugcagcaauuccugcagaag

SEQ ID NO: 74979 - RNA, 27 nt, Artificial Sequence
  26S proteasome non-ATPase regulatory subunit 8 (201-209)
aacacccccaagaaaaugacagacuac

SEQ ID NO: 74980 - RNA, 27 nt, Artificial Sequence
  G-protein coupled receptor 98 (3795-3803)
aacaccacaacucugcagcuccaaauc

SEQ ID NO: 74981 - RNA, 30 nt, Artificial Sequence; identical to SEQ ID NO: 50754
  Calsyntenin-1 (464-473)

SEQ ID NO: 74982 - RNA, 36 nt, Artificial Sequence
  39S ribosomal protein L2, mitochondrial (195-206)
aacguggagagcgaacccggcagaggggcccaguac

SEQ ID NO: 74983 - RNA, 33 nt, Artificial Sequence
  Geranylgeranyl transferase type-2 subunit beta (112-122)
aacgugaucgacgucaauaagguuguggaguac

SEQ ID NO: 74984 - RNA, 33 nt, Artificial Sequence
  Zinc finger protein 638 (207-217)
aacgugaucgacuacggccacgccagcaaguau

SEQ ID NO: 74985 - RNA, 30 nt, Artificial Sequence
  Neuropathy target esterase (1252-1261)
aacgugaucgagaagaugcugaccgacaga

SEQ ID NO: 74986 - RNA, 30 nt, Artificial Sequence
  Protein MMS22-like (799-808)
aacgugaucgagcaguacauuggcagauuc

SEQ ID NO: 74987 - RNA, 27 nt, Artificial Sequence
  Syndetin (606-614)
aacgugaucagacuggucggcaaguac

SEQ ID NO: 74988 - RNA, 27 nt, Artificial Sequence
  tRNA (guanine(37)-N1)-methyltransferase (163-171)
aacgugagcccccagaucuccaaguac

SEQ ID NO: 74989 - RNA, 33 nt, Artificial Sequence
  Probable crossover junction endonuclease EME2 (356-366)
cccgaccugagcagaaggaucugccucuuccuu

SEQ ID NO: 74990 - RNA, 33 nt, Artificial Sequence
  Neuronal acetylcholine receptor subunit alpha-3 (433-443)
cccgagaucaaggaagccauucagagcgugaaa

SEQ ID NO: 74991 - RNA, 27 nt, Artificial Sequence
  Ribosomal L1 domain-containing protein 1 (244-252)
cccgagaagugggaaagcgugaaacug

SEQ ID NO: 74992 - RNA, 27 nt, Artificial Sequence
  Galectin-3 (191-199)
cccuucgagagcggcaagccuuuuaaa

SEQ ID NO: 74993 - RNA, 33 nt, Artificial Sequence
  40S ribosomal protein S19 (2-12)
cccggcgugaccgucaaggacguuaaccagcaa

SEQ ID NO: 74994 - RNA, 24 nt, Artificial Sequence
  Carbohydrate sulfotransferase 5 (259-266)
ccccaccugagacucaucagggag

SEQ ID NO: 74995 - RNA, 30 nt, Artificial Sequence
  Myosin regulatory light chain 12A (152-161)
cccaucgacaagaaaggcaacuucaauuac

SEQ ID NO: 74996 - RNA, 33 nt, Artificial Sequence
  A-kinase anchor protein 11 (107-117)
ccccuggacaucagcuccgauccucucaaccag

SEQ ID NO: 74997 - RNA, 27 nt, Artificial Sequence
  SYTL2 protein (325-333)
ccccugagaaugcuccuuaucgccaag

SEQ ID NO: 74998 - RNA, 33 nt, Artificial Sequence
  Titin (13404-13414)
cccccuguggaggaaagagagaucgaaaaguac

SEQ ID NO: 74999 - RNA, 27 nt, Artificial Sequence
  Translation initiation factor eIF-2B subunit delta (205-213)
ccccaguacagcagacaaaacucccug

SEQ ID NO: 75000 - RNA, 27 nt, Artificial Sequence
  Ubiquitin-associated protein 2-like (957-965)
cccagcggcuacgggucccacggauau

SEQ ID NO: 75001 - RNA, 36 nt, Artificial Sequence
  Enhancer of filamentation 1 (121-132)
cccaccggccacgggacacaggagcaagaaguguac

SEQ ID NO: 75002 - RNA, 36 nt, Artificial Sequence
  Phosphatidylethanolamine-binding protein 1 (2-13)
cccguggaccugagcaagugguccggcccucucucu

SEQ ID NO: 75003 - RNA, 27 nt, Artificial Sequence
  DNA ligase 3 (547-555)
caggccuuccccggcgggcacagcaug

SEQ ID NO: 75004 - RNA, 27 nt, Artificial Sequence
  E3 ubiquitin-protein ligase BRE1B (135-143)
caggccggccccaucaacagagagaug

SEQ ID NO: 75005 - RNA, 27 nt, Artificial Sequence
  Tyrosine-protein phosphatase non-receptor type 20 (25-33)
caggcccugagcccccuccuuuccgug

SEQ ID NO: 75006 - RNA, 27 nt, Artificial Sequence
  Importin subunit beta-1 (408-416)
caggccaugcccacccugaucgagcuc

SEQ ID NO: 75007 - RNA, 30 nt, Artificial Sequence
  UBX domain-containing protein 6 (85-94)
caggaggaccccgaagaguucuacgugcug

SEQ ID NO: 75008 - RNA, 24 nt, Artificial Sequence
  Spectrin beta chain, non-erythrocytic 5 (1672-1679)
caggaggaacuggccaucuacugg

SEQ ID NO: 75009 - RNA, 39 nt, Artificial Sequence
  Growth/differentiation factor 15 (4-16)
caggagcugagaaccgugaacggcagccaaaugcuccuu

SEQ ID NO: 75010 - RNA, 30 nt, Artificial Sequence
  Ethanolamine kinase 1 (326-335)
caguucaucgacuacgaguauagcggcuac

SEQ ID NO: 75011 - RNA, 30 nt, Artificial Sequence
  Leucine-rich repeat-containing protein 15 (122-131)
cagggccuggacagccucgagucccuucug

SEQ ID NO: 75012 - RNA, 30 nt, Artificial Sequence; identical to SEQ ID NO: 50785
  Methyltransferase-like protein 25 (467-476)

SEQ ID NO: 75013 - RNA, 27 nt, Artificial Sequence
  Nuclear migration protein nudC (20-28)
cagcacgagggcggggugcaagaacug

SEQ ID NO: 75014 - RNA, 27 nt, Artificial Sequence
  Threonine-tRNA ligase, cytoplasmic (535-543)
cagaucaaggacgccauuggcagauac

SEQ ID NO: 75015 - RNA, 27 nt, Artificial Sequence
  Cytoplasmic dynein 1 heavy chain 1 (2212-2220)
cagaucacccaaauuaaccacggccug

SEQ ID NO: 75016 - RNA, 36 nt, Artificial Sequence
  Importin-8 (185-196)
cagaucgugcaacugcuccccgacagcuccuacuau

SEQ ID NO: 75017 - RNA, 30 nt, Artificial Sequence
  Histone-lysine N-methyltransferase SUV39H1 (268-277)
cagaucuacgacagacaaggcgccaccuau

SEQ ID NO: 75018 - RNA, 27 nt, Artificial Sequence
  PH and SEC7 domain-containing protein 3 (214-222)
cagaaggaccugaccgcccuccuuaca

SEQ ID NO: 75019 - RNA, 27 nt, Artificial Sequence
  Zinc finger and BTB domain-containing protein 37 (95-103)
cagcuggccgacaucauuagcuaccuc

SEQ ID NO: 75020 - RNA, 27 nt, Artificial Sequence
  Protein FAM98B (139-147)
cagcuggacaagaacagcgagguguac

SEQ ID NO: 75021 - RNA, 30 nt, Artificial Sequence
  Calsyntenin-1 (952-961)
cagcuggagugggacgauagcacccucucc

SEQ ID NO: 75022 - RNA, 27 nt, Artificial Sequence
  Poly (ADP-ribose) polymerase 4 (351-359)
cagcugaucagagacauggugaacguc

SEQ ID NO: 75023 - RNA, 27 nt, Artificial Sequence
  Rap guanine nucleotide exchange factor 6 (270-278)
cagcugcucgaguucaugcaccaacuu

SEQ ID NO: 75024 - RNA, 27 nt, Artificial Sequence
  Probable dimethyladenosine transferase (249-257)
cagcugcucgagaagaacuacagaauc

SEQ ID NO: 75025 - RNA, 33 nt, Artificial Sequence
  26S proteasome non-ATPase regulatory subunit 6 (306-316)
cagcugcucgagagcuacagaucccuuacccug

SEQ ID NO: 75026 - RNA, 27 nt, Artificial Sequence
  Chromosome-associated kinesin KIF4A (982-990)
cagcugcucagagagaacgaaaucauu

SEQ ID NO: 75027 - RNA, 33 nt, Artificial Sequence
  Voltage-gated potassium channel subunit beta-2 (329-339)
cagcugauggagaacaucggcgccauucaagug

SEQ ID NO: 75028 - RNA, 27 nt, Artificial Sequence
  Chromatin assembly factor 1 subunit B (113-121)
cagcugaacaaggagaauuggaccgug

SEQ ID NO: 75029 - RNA, 27 nt, Artificial Sequence
  Transcription activator BRG1 (179-187)
cagcugagagcccaaaucauggcuuac

SEQ ID NO: 75030 - RNA, 27 nt, Artificial Sequence
  Nuclear factor erythroid 2-related factor 1 (321-329)
cagcugagcgaggcccaacucucccuu

SEQ ID NO: 75031 - RNA, 27 nt, Artificial Sequence
  Protein AHNAK2 (5375-5383)
cagcugugggaggacagcgugcucacc

SEQ ID NO: 75032 - RNA, 27 nt, Artificial Sequence
  Alpha-2-macroglobulin receptor-associated protein (61-69)
cagcugugggagaaggcccaaagacuc

SEQ ID NO: 75033 - RNA, 27 nt, Artificial Sequence
  Lysine-specific histone demethylase 1A (239-247)
cagcuguggcucgacaaccccaagauc

SEQ ID NO: 75034 - RNA, 30 nt, Artificial Sequence; identical to SEQ ID NO: 50807
  YrdC domain-containing protein, mitochondrial (184-193)

SEQ ID NO: 75035 - RNA, 27 nt, Artificial Sequence
  U3 small nucleolar RNA-associated protein 14 homolog A (505-513)
cagaugaucgaccugcaaaaccuccuu

SEQ ID NO: 75036 - RNA, 27 nt, Artificial Sequence
  Sodium/myo-inositol cotransporter (686-694)
cagaugcuggaggaaaccagacaagug

SEQ ID NO: 75037 - RNA, 33 nt, Artificial Sequence
  Neuroblastoma-amplified sequence (2232-2242)
cagaugcugcccgccgagggcgugaaggaacuc

SEQ ID NO: 75038 - RNA, 27 nt, Artificial Sequence
  Vimentin (343-351)
cagaugagagagauggaagagaacuuc

SEQ ID NO: 75039 - RNA, 27 nt, Artificial Sequence
  Transmembrane emp24 domain-containing protein 4 (59-67)
cagaugugggacaagcaaaaagaggug

SEQ ID NO: 75040 - RNA, 27 nt, Artificial Sequence
  G protein-coupled receptor SNSR1 (285-293)
cagaaccugaagcucgugcuucaaaaa

SEQ ID NO: 75041 - RNA, 27 nt, Artificial Sequence
  DNA-directed RNA polymerase I subunit RPA2 (30-38)
cagcaaaaggccgcucugcaggagcuc

SEQ ID NO: 75042 - RNA, 27 nt, Artificial Sequence
  Histone-lysine N-methyltransferase 2C (1225-1233)
cagcaacagcagcagcaacagcaguuc

SEQ ID NO: 75043 - RNA, 27 nt, Artificial Sequence
  Synaptosomal-associated protein 29 (42-50)
cagcaauaccugagacaggaggugcuc

SEQ ID NO: 75044 - RNA, 36 nt, Artificial Sequence
  Vimentin (195-206)
cagagagaggaagccgagaacacccugcaaagcuuc

SEQ ID NO: 75045 - RNA, 27 nt, Artificial Sequence
  Very long-chain specific acyl-CoA dehydrogenase, mitochondrial (600-608)
cagagcgaccccuggcaacaggagcug

SEQ ID NO: 75046 - RNA, 30 nt, Artificial Sequence
  Neuropilin-2 (690-699)
cagagcgacucccaaagagagggccaguac

SEQ ID NO: 75047 - RNA, 27 nt, Artificial Sequence
  Kelch-like protein 42 (26-34)
cagagcgacuacuucagagcccuguau

SEQ ID NO: 75048 - RNA, 33 nt, Artificial Sequence
  HLA class I histocompatibility antigen, B-8 alpha chain (111-121)
cagagcgaggccggcucccacacccugcaaucu

SEQ ID NO: 75049 - RNA, 39 nt, Artificial Sequence
  HLA class I histocompatibility antigen, A-66 alpha chain (86-98)
cagagcgaggacggcucccacaccauccaaagaauguac

SEQ ID NO: 75050 - RNA, 42 nt, Artificial Sequence
  Cold-inducible RNA-binding protein (147-160)
cagagcggcggguacuccgacagaucuucaggagguaguuau

SEQ ID NO: 75051 - RNA, 39 nt, Artificial Sequence
  Caprin-1 (653-665)
cagagccaauucuccgcccccagagacuacucuggcuau

SEQ ID NO: 75052 - RNA, 30 nt, Artificial Sequence
  Zinc finger and BTB domain-containing protein 17 (685-694)
cagaccgacgccgauuucuaccaacaguau

SEQ ID NO: 75053 - RNA, 27 nt, Artificial Sequence
  RNA polymerase-associated protein CTR9 homolog (424-432)
cagaccgacauccaaggcgcccugagc

SEQ ID NO: 75054 - RNA, 30 nt, Artificial Sequence
  Glia-derived nexin (301-310)
cagaccgaccugaaggagccccucaaagug

SEQ ID NO: 75055 - RNA, 33 nt, Artificial Sequence
  Calreticulin (119-129)
cagaccgacaugcacggcgauagcgaguacaac

SEQ ID NO: 75056 - RNA, 27 nt, Artificial Sequence
  Intraflagellar transport protein 172 homolog (85-93)
cagaccgacaacaucauuuacguguau

SEQ ID NO: 75057 - RNA, 30 nt, Artificial Sequence
  Putative E3 ubiquitin-protein ligase UNKL (18-27)
cagaccgagaagcccacacacuacagauau

SEQ ID NO: 75058 - RNA, 30 nt, Artificial Sequence
  Zinc finger protein 217 (667-676)
cagaccgagacagccgcugacugcagauac

SEQ ID NO: 75059 - RNA, 27 nt, Artificial Sequence
  Interleukin-13 receptor subunit alpha-1 (268-276)
cagaccgagacacacaacguguucuac

SEQ ID NO: 75060 - RNA, 27 nt, Artificial Sequence
  Centrosomal protein of 295 kDa (745-753)
cagaccgagacacaacagagagacuac

SEQ ID NO: 75061 - RNA, 27 nt, Artificial Sequence
  Basic leucine zipper and W2 domain-containing protein 1 (165-173)
cagaccaucggcgccagaaaggagcug

SEQ ID NO: 75062 - RNA, 27 nt, Artificial Sequence
  Ubiquitin carboxyl-terminal hydrolase 32 (111-119)
cagaccaucaaggagauucacgaauac

SEQ ID NO: 75063 - RNA, 30 nt, Artificial Sequence
  Zinc fingers and homeoboxes protein 3 (607-616)
cagacccccgacuucacaccuacuaaguac

SEQ ID NO: 75064 - RNA, 33 nt, Artificial Sequence
  Glycerol-3-phosphate dehydrogenase 1-like protein (226-236)
cagaccagcgccgagguguacagaauccugaag

SEQ ID NO: 75065 - RNA, 27 nt, Artificial Sequence
  Probable ATP-dependent RNA helicase DDX47 (228-236)
cagaccguggagaagcugcaacaguac

SEQ ID NO: 75066 - RNA, 30 nt, Artificial Sequence; identical to SEQ ID NO: 50839
  WD repeat-containing protein 62 (147-156)

SEQ ID NO: 75067 - RNA, 30 nt, Artificial Sequence
  Ran GTPase-activating protein 1 (17-26)
cagguggccggcgggcaacugagcuucaag

SEQ ID NO: 75068 - RNA, 27 nt, Artificial Sequence
  Pre-mRNA-processing factor 19 (209-217)
cagguggccagccacgucggccugcau

SEQ ID NO: 75069 - RNA, 33 nt, Artificial Sequence
  Rootletin (1601-1611)
cagguggccacccuggagagaagccuccaagcu

SEQ ID NO: 75070 - RNA, 36 nt, Artificial Sequence
  Tripartite motif-containing protein 2 (694-705)
cagguguucgacggcagcggguccuuucugucuuac

SEQ ID NO: 75071 - RNA, 30 nt, Artificial Sequence
  Basic leucine zipper and W2 domain-containing protein 2 (113-122)
cagguguucaacaagcugaucagaagguac

SEQ ID NO: 75072 - RNA, 30 nt, Artificial Sequence
  Sec1 family domain-containing protein 2 (210-219)
caggugaucgccgcugaccuggcaaacuac

SEQ ID NO: 75073 - RNA, 33 nt, Artificial Sequence
  Putative Polycomb group protein ASXL1 (36-46)
caggugaucgaggccgaaggccugaaggagaug

SEQ ID NO: 75074 - RNA, 33 nt, Artificial Sequence
  SURP and G-patch domain-containing protein 2 (69-79)
caggugaucggccacagaaagcuggggcauuuc

SEQ ID NO: 75075 - RNA, 27 nt, Artificial Sequence
  Vimentin (453-461)
caggugaucaacgagaccagccaacac

SEQ ID NO: 75076 - RNA, 30 nt, Artificial Sequence
  Vimentin (453-462)
caggugaucaacgagaccagccaacaccau

SEQ ID NO: 75077 - RNA, 36 nt, Artificial Sequence
  Vimentin (453-464)
caggugaucaacgagaccagccaacaccaugacgau

SEQ ID NO: 75078 - RNA, 27 nt, Artificial Sequence
  Splicing factor U2AF 65 kDa subunit (274-282)
caggugaaggagcugcucaccagcuuc

SEQ ID NO: 75079 - RNA, 27 nt, Artificial Sequence
  Glutathione-specific gamma-glutamylcyclotransferase 1 (98-106)
caggugcaaggcgagcaggucagcaag

SEQ ID NO: 75080 - RNA, 30 nt, Artificial Sequence
  tRNA-splicing ligase RtcB homolog (232-241)
cagguggucgacgagaucuucaacgaauac

SEQ ID NO: 75081 - RNA, 30 nt, Artificial Sequence
  Xylulose kinase (511-520)
cagguguacgaggcccugcucccccaauau

SEQ ID NO: 75082 - RNA, 30 nt, Artificial Sequence
  2'-5'-oligoadenylate synthase 3 (908-917)
cagguguacgucgaccugauccacagcuau

SEQ ID NO: 75083 - RNA, 27 nt, Artificial Sequence
  FERM domain-containing protein 8 (28-36)
agagccgcugacgugcuggucuaccuc

SEQ ID NO: 75084 - RNA, 27 nt, Artificial Sequence
  Non-canonical poly(A) RNA polymerase PAPD7 (152-160)
agagccgcugaguucaucaagaacuac

SEQ ID NO: 75085 - RNA, 27 nt, Artificial Sequence
  Nuclear export mediator factor NEMF (136-144)
agagccgcugagccccugcucacccuu

SEQ ID NO: 75086 - RNA, 39 nt, Artificial Sequence
  Non-POU domain-containing octamer-binding protein (367-379)
agagccgcucccggcgcagaguucgccccuaacaagagg

SEQ ID NO: 75087 - RNA, 33 nt, Artificial Sequence
  Fatty acid synthase (2275-2285)
agagccgcuccccuggacagcauccacucccuc

SEQ ID NO: 75088 - RNA, 30 nt, Artificial Sequence
  Sodium/potassium-transporting ATPase subunit alpha-3 (42-51)
agagccgcugugcccgacgcagucggcaag

SEQ ID NO: 75089 - RNA, 27 nt, Artificial Sequence
  Nuclear pore complex protein Nup205 (413-421)
agagccgacgaggaugcuaggaugauc

SEQ ID NO: 75090 - RNA, 27 nt, Artificial Sequence
  Uncharacterized protein KIAA0930 (312-320)
agagccgacggcaacuuccugcucuac

SEQ ID NO: 75091 - RNA, 27 nt, Artificial Sequence
  Cytochrome b-c1 complex subunit 9 (34-42)
agagccuucgaccagggcgcugaugca

SEQ ID NO: 75092 - RNA, 33 nt, Artificial Sequence
  E3 ubiquitin-protein ligase DTX3L (679-689)
agagccuucgaccagaagcugaucuuuaccgug

SEQ ID NO: 75093 - RNA, 27 nt, Artificial Sequence
  Protein transport protein Sec16A (1122-1130)
agagccuuccccggcccucuggcuaag

SEQ ID NO: 75094 - RNA, 30 nt, Artificial Sequence
  Protein ECT2 (107-116)
agagccuucagcuuuuccaagacccccaaa

SEQ ID NO: 75095 - RNA, 27 nt, Artificial Sequence
  Rho GTPase-activating protein 11B (16-24)
agagccuucuacggcaucaaggugaaa

SEQ ID NO: 75096 - RNA, 33 nt, Artificial Sequence
  Glutaminyl-peptide cyclotransferase (172-182)
agagcccuggacaagaaacuccuuagccugaag

SEQ ID NO: 75097 - RNA, 27 nt, Artificial Sequence
  Clathrin heavy chain 1 (625-633)
agagcccuggagcacuucaccgaccuc

SEQ ID NO: 75098 - RNA, 27 nt, Artificial Sequence
  Guanine nucleotide exchange factor DBS (926-934)
agagcccuggagcagagccaaucccuc

SEQ ID NO: 75099 - RNA, 27 nt, Artificial Sequence
  ALX homeobox protein 1 (94-102)
agagccauggacaacugcaauagccug

SEQ ID NO: 75100 - RNA, 30 nt, Artificial Sequence
  Inositol hexakisphosphate kinase 2 (6-15)
agagccauggacguggagcccagggcuaag

SEQ ID NO: 75101 - RNA, 27 nt, Artificial Sequence
  Hsp70-binding protein 1 (283-291)
agagccaugcagcaacaggugcagaag

SEQ ID NO: 75102 - RNA, 27 nt, Artificial Sequence
  Ankyrin-2 (388-396)
agagccaaccccaaugcuagggcacug

SEQ ID NO: 75103 - RNA, 39 nt, Artificial Sequence
  N-terminal kinase-like protein (673-685)
agagccagccagucccccaccggcgcugcagggaagcug

SEQ ID NO: 75104 - RNA, 27 nt, Artificial Sequence
  Retinoic acid receptor alpha (15-23)
agagccaccagcuccacacagucucug

SEQ ID NO: 75105 - RNA, 27 nt, Artificial Sequence
  Coiled-coil domain-containing protein 124 (215-223)
agagccgugcccuucaacgcuccuaag

SEQ ID NO: 75106 - RNA, 27 nt, Artificial Sequence
  Eukaryotic peptide chain release factor GTP-binding subunit ERF3A (143-151)
agagccuacuucgagaccgaaaagaaa

SEQ ID NO: 75107 - RNA, 30 nt, Artificial Sequence
  CCR4-NOT transcription complex subunit 1 (1694-1703)
agagccuacggcagccccuggugcaacaag

SEQ ID NO: 75108 - RNA, 27 nt, Artificial Sequence
  E3 ubiquitin-protein ligase UBR5 (1124-1132)
agagccuaccccgcugcaaucaccauu

SEQ ID NO: 75109 - RNA, 30 nt, Artificial Sequence
  SWI/SNF-related matrix-associated actin-dependent regulator of chromatin subfamily E member 1-related (135-144)
agagccuaccagcaaagcgaggcuuauaag

SEQ ID NO: 75110 - RNA, 27 nt, Artificial Sequence
  Hermansky-Pudlak syndrome 3 protein (89-97)
agagccuacgugaacuggaggaauaag

SEQ ID NO: 75111 - RNA, 27 nt, Artificial Sequence
  60S ribosomal protein L37 (21-29)
agaugcggcagcaaggccuaccaccug

SEQ ID NO: 75112 - RNA, 42 nt, Artificial Sequence
  PEST proteolytic signal-containing nuclear protein (112-125)
agagacacccccacaagcgccggcccuaacuccuucaauaag

SEQ ID NO: 75113 - RNA, 30 nt, Artificial Sequence
  Nuclear mitotic apparatus protein 1 (76-85)
agagaggccgaacagaugggcaacgagcug

SEQ ID NO: 75114 - RNA, 30 nt, Artificial Sequence
  Melanotransferrin (44-53)
agagaggccggcauccagcccagccugcuc

SEQ ID NO: 75115 - RNA, 30 nt, Artificial Sequence
  Kinesin-like protein (353-362)
agagaggccggcaacaucaaucagagccug

SEQ ID NO: 75116 - RNA, 27 nt, Artificial Sequence
  Vacuolar protein sorting-associated protein 72 homolog (174-182)
agagaggccaagaucaccgaagagcug

SEQ ID NO: 75117 - RNA, 27 nt, Artificial Sequence
  Src substrate cortactin (417-425)
agagaggccagcucccagcaaggccug

SEQ ID NO: 75118 - RNA, 33 nt, Artificial Sequence
  Cullin-4B (258-268)
agagaggacagccuggauuccgugcucuuccuu

SEQ ID NO: 75119 - RNA, 30 nt, Artificial Sequence
  Beta-citrylglutamate synthase B (18-27)
agagaggacuacccccagaaggaaauccug

SEQ ID NO: 75120 - RNA, 30 nt, Artificial Sequence
  RE1-silencing transcription factor (872-881)
agagaggaagccagcggcgaccagaagcug

SEQ ID NO: 75121 - RNA, 36 nt, Artificial Sequence
  39S ribosomal protein L37, mitochondrial (242-253)
agagaggaaaucgaggccaccaagaaccacgugcug

SEQ ID NO: 75122 - RNA, 27 nt, Artificial Sequence
  ATP-dependent RNA helicase DHX36 (91-99)
agagaggaacagaucgugcaacugcuc

SEQ ID NO: 75123 - RNA, 27 nt, Artificial Sequence
  60S ribosomal protein L3-like (69-77)
agagaggaaguggaggccgucaccauc

SEQ ID NO: 75124 - RNA, 30 nt, Artificial Sequence
  Colorectal mutant cancer protein (584-593)
agagaguucgaaguggagaccgaaaggcug

SEQ ID NO: 75125 - RNA, 33 nt, Artificial Sequence
  Proteasome subunit alpha type-7 (169-179)
agagaguuccuggaaaagaacuacaccgacgag

SEQ ID NO: 75126 - RNA, 27 nt, Artificial Sequence
  TBC1 domain family member 16 (242-250)
agagaguuccccgaagccgaggcucug

SEQ ID NO: 75127 - RNA, 27 nt, Artificial Sequence
  Leucine-rich repeat and calponin homology domain-containing protein 3 (427-435)
agagaguuccagaagaccgaagacaug

SEQ ID NO: 75128 - RNA, 27 nt, Artificial Sequence
  5,6-dihydroxyindole-2-carboxylic acid oxidase (471-479)
agagaguucagcgugcccgaaaucauu

SEQ ID NO: 75129 - RNA, 27 nt, Artificial Sequence
  Rhophilin-2 (553-561)
agagagggcgacuacaucgugagcauu

SEQ ID NO: 75130 - RNA, 33 nt, Artificial Sequence
  Contactin-associated protein-like 3B (224-234)
agagagggccagcacgggaaccauaucacccug

SEQ ID NO: 75131 - RNA, 36 nt, Artificial Sequence
  Colorectal mutant cancer protein (255-266)
agagagcacgaagacgugcaggagaggaccacacug

SEQ ID NO: 75132 - RNA, 27 nt, Artificial Sequence
  Protein orai-2 (155-163)
agagagaucgaagagcugcacaagcuc

SEQ ID NO: 75133 - RNA, 27 nt, Artificial Sequence
  Pyridoxal-dependent decarboxylase domain-containing protein 1 (596-604)
agagagaucgaagagaacagcaggcug

SEQ ID NO: 75134 - RNA, 27 nt, Artificial Sequence
  Zinc finger FYVE domain-containing protein 16 (199-207)
agagagaucggcgggauuaaggaacug

SEQ ID NO: 75135 - RNA, 33 nt, Artificial Sequence
  Cathepsin K (225-235)
agagagauccccgaaggcaacgagaaggcccug

SEQ ID NO: 75136 - RNA, 27 nt, Artificial Sequence
  Calcineurin-binding protein cabin-1 (253-261)
agagagaaggaacccgaccugaaacuc

SEQ ID NO: 75137 - RNA, 27 nt, Artificial Sequence
  B-cell lymphoma 3 protein (77-85)
agagagcuggacaucuacaacaaucuc

SEQ ID NO: 75138 - RNA, 27 nt, Artificial Sequence
  Serine/threonine-protein kinase Nek9 (195-203)
agagagauggaagagaaggugacccug

SEQ ID NO: 75139 - RNA, 27 nt, Artificial Sequence
  Vimentin (345-353)
agagagauggaagagaacuucgccgug

SEQ ID NO: 75140 - RNA, 27 nt, Artificial Sequence
  Mitogen-activated protein kinase kinase kinase 1 (162-170)
agagagauggaaaacaaggagacccug

SEQ ID NO: 75141 - RNA, 30 nt, Artificial Sequence
  Protein lin-9 homolog (312-321)
agagagaugaacaccgaagccgagaagcug

SEQ ID NO: 75142 - RNA, 30 nt, Artificial Sequence
  KN motif and ankyrin repeat domain-containing protein 1 (483-492)
agagagaugaccaagcugaaacaggaacuc

SEQ ID NO: 75143 - RNA, 30 nt, Artificial Sequence
  Sorting nexin-29 (92-101)
agagagaacgaagugcugaagguccagcuc

SEQ ID NO: 75144 - RNA, 27 nt, Artificial Sequence
  RNA-binding protein 27 (502-510)
agagagaacaaugaacagcccacccug

SEQ ID NO: 75145 - RNA, 33 nt, Artificial Sequence
  N-alpha-acetyltransferase 11 (175-185)
agagagaaccaggaaacccaaggcagcacacug

SEQ ID NO: 75146 - RNA, 30 nt, Artificial Sequence
  Heterogeneous nuclear ribonucleoprotein K (171-180)
agagagaacacccagacaacuaucaagcug

SEQ ID NO: 75147 - RNA, 33 nt, Artificial Sequence
  Probable ATP-dependent RNA helicase DDX5 (511-521)
agagagaacuacgacaggggcuauagcucccug

SEQ ID NO: 75148 - RNA, 36 nt, Artificial Sequence
  Probable ATP-dependent RNA helicase DDX5 (511-522)
agagagaacuacgacaggggcuauagcucccugcuc

SEQ ID NO: 75149 - RNA, 30 nt, Artificial Sequence
  Hsp70-binding protein 1 (357-366)
agagagcccgaacugggccucgaggaacuu

SEQ ID NO: 75150 - RNA, 30 nt, Artificial Sequence
  Tripartite motif-containing protein 65 (51-60)
agagagcccuucccugacggcgccgaacug

SEQ ID NO: 75151 - RNA, 30 nt, Artificial Sequence
  Melanoma-associated antigen 2 (155-164)
agagagcccgugaccaaggccgaaaugcug

SEQ ID NO: 75152 - RNA, 27 nt, Artificial Sequence
  FAS-associated factor 1 (349-357)
agagagcaggacgaagccuacaggcug

SEQ ID NO: 75153 - RNA, 27 nt, Artificial Sequence
  Intersectin-2 (475-483)
agagagcaggaagagaucgugaggcug

SEQ ID NO: 75154 - RNA, 30 nt, Artificial Sequence
  L-dopachrome tautomerase (138-147)
agagagcaguuccugggcgcccucgaccuu

SEQ ID NO: 75155 - RNA, 33 nt, Artificial Sequence
  Ras-responsive element-binding protein 1 (361-371)
agagagcagcccagcgaaggcgccaccgagcug

SEQ ID NO: 75156 - RNA, 27 nt, Artificial Sequence
  Microtubule-actin cross-linking factor 1, isoforms 1/2/3/5 (4309-4317)
agagagcagcaacugcagagcacccuc

SEQ ID NO: 75157 - RNA, 27 nt, Artificial Sequence
  V-type proton ATPase subunit D (194-202)
agagagagggaagaguucuaccggcug

SEQ ID NO: 75158 - RNA, 27 nt, Artificial Sequence
  Eukaryotic translation initiation factor 4B (372-380)
agagagagggaaguggaggaacggcug

SEQ ID NO: 75159 - RNA, 33 nt, Artificial Sequence
  Proteasome activator complex subunit 3 (19-29)
agagagaggaucaccagcgaagccgaggaccug

SEQ ID NO: 75160 - RNA, 27 nt, Artificial Sequence
  Lysosomal-trafficking regulator (1440-1448)
agagagagcuucccccacaggcugcuc

SEQ ID NO: 75161 - RNA, 30 nt, Artificial Sequence
  Cytoplasmic dynein 1 intermediate chain 1 (57-66)
agagagaccgaagcccugcuccagagcauc

SEQ ID NO: 75162 - RNA, 30 nt, Artificial Sequence
  Annexin A5 (227-236)
agagagaccagcggcaaccuggaacagcuc

SEQ ID NO: 75163 - RNA, 33 nt, Artificial Sequence
  Dexamethasone-induced Ras-related protein 1 (153-163)
agagagguggaccagagggaaaucgagcaacug

SEQ ID NO: 75164 - RNA, 39 nt, Artificial Sequence
  Dual specificity protein phosphatase 10 (294-306)
agagaggugggcgggggagccagcgcugcauccucucug

SEQ ID NO: 75165 - RNA, 33 nt, Artificial Sequence
  Transmembrane channel-like protein 6 (57-67)
agagaggugaccggcagcucccagcaaacacug

SEQ ID NO: 75166 - RNA, 30 nt, Artificial Sequence
  Sarcoplasmic/endoplasmic reticulum calcium ATPase 2 (549-558)
agagaguggggcagcggguccgacacccug

SEQ ID NO: 75167 - RNA, 30 nt, Artificial Sequence
  GPN-loop GTPase 1 (251-260)
agagaguacaggcccgaauaugagcggcug

SEQ ID NO: 75168 - RNA, 27 nt, Artificial Sequence
  Rab-like protein 3 (198-206)
agauucuuugacaaggugaucgagaaa

SEQ ID NO: 75169 - RNA, 30 nt, Artificial Sequence
  DNA mismatch repair protein Msh3 (26-35)
agauucuuucagagcaccggcucccugaag

SEQ ID NO: 75170 - RNA, 54 nt, Artificial Sequence
  Transgelin-2 (182-199)
agaggcgccagccaggcugggaugaccggauacgguaugcccaggcaaauccug

SEQ ID NO: 75171 - RNA, 33 nt, Artificial Sequence
  F-box/LRR-repeat protein 4 (358-368)
agaggcuucaucagcguggccggguuuuccagg

SEQ ID NO: 75172 - RNA, 33 nt, Artificial Sequence
  Isocitrate dehydrogenase (NAD) subunit alpha, mitochondrial (25-35)
agaggcuucaccgggggaaucaacuuugccaag

SEQ ID NO: 75173 - RNA, 27 nt, Artificial Sequence
  POM121 and ZP3 fusion protein (9-17)
agaaucgcccccccugacaggcgguuc

SEQ ID NO: 75174 - RNA, 33 nt, Artificial Sequence
  Histone H2B type 1-A (74-84)
agaaucgccagcgaggcuuccaggcuggcacac

SEQ ID NO: 75175 - RNA, 27 nt, Artificial Sequence
  Cell division cycle 5-like protein (33-41)
agaaucgccagccugcuccacaggaag

SEQ ID NO: 75176 - RNA, 30 nt, Artificial Sequence
  Transmembrane protein 230 (98-107)
agaaucgccuacuaugcuagcaagggcuac

SEQ ID NO: 75177 - RNA, 27 nt, Artificial Sequence
  Galectin-3-binding protein (216-224)
agaaucgacauuacccugagcuccgug

SEQ ID NO: 75178 - RNA, 27 nt, Artificial Sequence
  Nuclear pore complex protein Nup88 (356-364)
agaaucgaccugauucccagccucuac

SEQ ID NO: 75179 - RNA, 33 nt, Artificial Sequence
  Dolichyl-diphosphooligosaccharide-proteinosyltransferase 48 kDa subunit (359-369)
agaaucgaccccuucgugaggaccuuucugaag

SEQ ID NO: 75180 - RNA, 33 nt, Artificial Sequence
  78 kDa glucose-regulated protein (540-550)
agaaucgacaccaggaacgagcuggaaagcuac

SEQ ID NO: 75181 - RNA, 27 nt, Artificial Sequence
  Tuftelin-interacting protein 11 (402-410)
agaaucuucgagacccugcaggacaag

SEQ ID NO: 75182 - RNA, 27 nt, Artificial Sequence
  DNA-directed RNA polymerase III subunit RPC3 (364-372)
agaaucuucaggcuggugcuccagaag

SEQ ID NO: 75183 - RNA, 27 nt, Artificial Sequence
  Serine/threonine-protein phosphatase 2A regulatory subunit B'' subunit beta (354-362)
agaaucuucagcggcgccgugaccagg

SEQ ID NO: 75184 - RNA, 39 nt, Artificial Sequence
  Interleukin enhancer-binding factor 3 (5-17)
agaaucuucgugaacgacgauaggcacgucauggccaag

SEQ ID NO: 75185 - RNA, 27 nt, Artificial Sequence
  Peroxisome biogenesis factor 10 (83-91)
agaauccacgugcccagcucccugagg

SEQ ID NO: 75186 - RNA, 27 nt, Artificial Sequence
  A-kinase anchor protein 13 (58-66)
agaaucauugacagcaaguuccugaaa

SEQ ID NO: 75187 - RNA, 27 nt, Artificial Sequence
  Oligoribonuclease, mitochondrial (133-141)
agaaucauugacgugagcaccgucaag

SEQ ID NO: 75188 - RNA, 27 nt, Artificial Sequence
  Actin filament-associated protein 1-like 1 (363-371)
agaaucauuggcuucagcaagaaaaag

SEQ ID NO: 75189 - RNA, 33 nt, Artificial Sequence
  Choline kinase alpha (244-254)
agaaucaaguucaccgaggaaagcaggauuaaa

SEQ ID NO: 75190 - RNA, 27 nt, Artificial Sequence
  Endothelin B receptor (208-216)
agaaucaagggcauuggggugcccaaa

SEQ ID NO: 75191 - RNA, 30 nt, Artificial Sequence
  Uncharacterized protein C1orf21 (35-44)
agaaucaagcccguggaggaagucaaauac

SEQ ID NO: 75192 - RNA, 27 nt, Artificial Sequence
  Chromodomain-helicase-DNA-binding protein 8 (579-587)
agaauccuggacgagagccacuccauu

SEQ ID NO: 75193 - RNA, 30 nt, Artificial Sequence
  SH3 domain-binding glutamic acid-rich-like protein 3 (159-168)
agaauccuggacggcaagaggauucaguac

SEQ ID NO: 75194 - RNA, 36 nt, Artificial Sequence
  Ubiquitin conjugation factor E4 B (856-867)
agaauccuggaccccgccuacccugauauuacccuc

SEQ ID NO: 75195 - RNA, 27 nt, Artificial Sequence
  Shugoshin-like 2 (1098-1106)
agaauccuggacagcgugcagggcaag

SEQ ID NO: 75196 - RNA, 33 nt, Artificial Sequence
  Serine/threonine-protein phosphatase 6 regulatory subunit 3 (385-395)
agaauccuggaggccugggaaaugaacgagaag

SEQ ID NO: 75197 - RNA, 33 nt, Artificial Sequence
  60S ribosomal protein L19 (117-127)
agaauccugauggagcacauucauaagcucaaa

SEQ ID NO: 75198 - RNA, 33 nt, Artificial Sequence
  Eukaryotic translation initiation factor 3 subunit A (623-633)
agaauccugcaggagcacgaacaaauuaagaaa

SEQ ID NO: 75199 - RNA, 30 nt, Artificial Sequence
  Pre-mRNA-splicing factor ATP-dependent RNA helicase DHX15 (666-675)
agaaucauggacagguucaaccugccccgg

SEQ ID NO: 75200 - RNA, 33 nt, Artificial Sequence
  Cell differentiation protein RCD1 homolog (169-179)
agaaucauggagagcggcuccgaacugucuaag

SEQ ID NO: 75201 - RNA, 33 nt, Artificial Sequence
  Elongation factor 2 (428-438)
agaaucaugggccccaacuacaccccugggaag

SEQ ID NO: 75202 - RNA, 33 nt, Artificial Sequence
  Calcineurin binding protein 1, isoform CRA_c (308-318)
agaaucaugagcgagaccuacaugcugauuaag

SEQ ID NO: 75203 - RNA, 27 nt, Artificial Sequence
  Synaptonemal complex central element protein 1 (59-67)
agaaucaacgaggugcagcaagccaag

SEQ ID NO: 75204 - RNA, 30 nt, Artificial Sequence
  Ninein (1240-1249)
agaauccccgaggccagcccuaaguacaaa

SEQ ID NO: 75205 - RNA, 30 nt, Artificial Sequence
  Ribosomal protein 63, mitochondrial (11-20)
agaauccccggcaggcaguggauugggaag

SEQ ID NO: 75206 - RNA, 33 nt, Artificial Sequence
  Cullin-1 (328-338)
agaauccaggacggccugggggagcucaagaaa

SEQ ID NO: 75207 - RNA, 33 nt, Artificial Sequence
  Malate dehydrogenase, mitochondrial (229-239)
agaauccaggaggccggcaccgaaguggucaag

SEQ ID NO: 75208 - RNA, 27 nt, Artificial Sequence
  Spectrin beta chain, non-erythrocytic 1 (1245-1253)
agaauccaggagaagguggacagcauu

SEQ ID NO: 75209 - RNA, 30 nt, Artificial Sequence
  Thyroid adenoma-associated protein (692-701)
agaauccaggagagcucccaagugcuguac

SEQ ID NO: 75210 - RNA, 27 nt, Artificial Sequence
  DNA replication licensing factor MCM6 (207-215)
agaauccaggagacccaagccgaacug

SEQ ID NO: 75211 - RNA, 27 nt, Artificial Sequence
  Antigen KI-67 (38-46)
agaauccagcugcccguggucagcaag

SEQ ID NO: 75212 - RNA, 27 nt, Artificial Sequence
  RNA-binding E3 ubiquitin-protein ligase MEX3C (156-164)
agaauccagcaacagacccacacauac

SEQ ID NO: 75213 - RNA, 33 nt, Artificial Sequence
  Tubulin beta chain (18-28)
agaaucagcgagcaguucaccgccauguuuagg

SEQ ID NO: 75214 - RNA, 27 nt, Artificial Sequence
  Zinc finger protein 529 (330-338)
agaaucagcucccagcugauugagcac

SEQ ID NO: 75215 - RNA, 27 nt, Artificial Sequence
  Lysine-specific histone demethylase 1B (473-481)
agaaucaccgaccccacaauugauaag

SEQ ID NO: 75216 - RNA, 30 nt, Artificial Sequence
  Cleavage stimulation factor subunit 2 (179-188)
agaaucguggaccccgagauugcccugaag

SEQ ID NO: 75217 - RNA, 27 nt, Artificial Sequence
  Unconventional myosin-X (239-247)
agaaucguggacuaccugcucgagaag

SEQ ID NO: 75218 - RNA, 27 nt, Artificial Sequence
  CDP-diacylglycerol-glycerol-3-phosphate 3-phosphatidyltransferase, mitochondrial (76-84)
agaaucuggagccugcaguucuccagg

SEQ ID NO: 75219 - RNA, 27 nt, Artificial Sequence
  Dynein heavy chain 6, axonemal (191-199)
agaaucuacgccgcuaccuucgagaag

SEQ ID NO: 75220 - RNA, 30 nt, Artificial Sequence
  DNA-directed RNA polymerase II subunit RPB2 (409-418)
agaaucuacgcccagaaguucauugacagg

SEQ ID NO: 75221 - RNA, 27 nt, Artificial Sequence
  U4/U6 small nuclear ribonucleoprotein Prp31 (203-211)
agaaucuacgaguauguggaaagcagg

SEQ ID NO: 75222 - RNA, 27 nt, Artificial Sequence
  Long-chain-fatty-acid-CoA ligase 4 (339-347)
agaaucuacaagaacgugaugagcaaa

SEQ ID NO: 75223 - RNA, 27 nt, Artificial Sequence
  28S ribosomal protein S21, mitochondrial (50-58)
agaaucuacaacauggagauggccagg

SEQ ID NO: 75224 - RNA, 27 nt, Artificial Sequence
  Ankyrin repeat and SOCS box protein 4 (318-326)
agaaucuaccccccucaguuccacaag

SEQ ID NO: 75225 - RNA, 27 nt, Artificial Sequence
  Transformation/transcription domain-associated protein (296-304)
agaaucuaccaggagcuggugaccaag

SEQ ID NO: 75226 - RNA, 30 nt, Artificial Sequence
  Semaphorin-5A (736-745)
agacuggccgaccccaaccuccuugaggug

SEQ ID NO: 75227 - RNA, 27 nt, Artificial Sequence
  Long-chain fatty acid transport protein 3 (117-125)
agacuggccgagcucgcucagcaaagg

SEQ ID NO: 75228 - RNA, 33 nt, Artificial Sequence
  E3 ubiquitin-protein ligase TRIM56 (291-301)
agacuggccgagcucgaaggcagggagcaggug

SEQ ID NO: 75229 - RNA, 27 nt, Artificial Sequence
  Catenin beta-1 (124-132)
agacuggccgagcccagccagaugcuc

SEQ ID NO: 75230 - RNA, 27 nt, Artificial Sequence
  14-3-3 protein eta (12-20)
agacuggccgagcaggcugaaagguac

SEQ ID NO: 75231 - RNA, 27 nt, Artificial Sequence
  Syntaxin-binding protein 1 (171-179)
agacuggccgagcagaucgcuacccuc

SEQ ID NO: 75232 - RNA, 27 nt, Artificial Sequence
  GPALPP motifs-containing protein 1 (89-97)
agacuggccgagcaggugagcuccuac

SEQ ID NO: 75233 - RNA, 30 nt, Artificial Sequence
  Ubiquitin carboxyl-terminal hydrolase 19 (897-906)
agacuggccgaggugaucaagaacagguuc

SEQ ID NO: 75234 - RNA, 33 nt, Artificial Sequence
  Receptor tyrosine-protein kinase erbB-3 (916-926)
agacuggccgaggugcccgaccuccuugaaaag

SEQ ID NO: 75235 - RNA, 33 nt, Artificial Sequence
  Catenin beta-1 (274-284)
agacuggccggcgggcuccagaagaugguggcu

SEQ ID NO: 75236 - RNA, 27 nt, Artificial Sequence
  Echinoderm microtubule-associated protein-like 3 (815-823)
agacuggcccccaggcucgcuggccgg

SEQ ID NO: 75237 - RNA, 27 nt, Artificial Sequence
  Nucleolar protein 56 (212-220)
agacuggcccaguucaucggcaacagg

SEQ ID NO: 75238 - RNA, 27 nt, Artificial Sequence
  Sorting nexin-17 (261-269)
agacuggcccagacccucaggcacuac

SEQ ID NO: 75239 - RNA, 36 nt, Artificial Sequence
  Microtubule-associated protein 4 (922-933)
agacuggccaccaacacaagcgcucccgaccucaag

SEQ ID NO: 75240 - RNA, 27 nt, Artificial Sequence
  P2X purinoceptor 7 (277-285)
agacuggacgauaagaccacaaacgug

SEQ ID NO: 75241 - RNA, 33 nt, Artificial Sequence
  Nuclear RNA export factor 1 (219-229)
agacuggacgauaugagcuccaucgugcagaag

SEQ ID NO: 75242 - RNA, 30 nt, Artificial Sequence
  Potassium voltage-gated channel subfamily G member 3 (115-124)
agacuggacgauaggaugagcgacaccuac

SEQ ID NO: 75243 - RNA, 30 nt, Artificial Sequence
  FERM domain-containing protein 6 (225-234)
agacuggacgauguggccguccacuacuau

SEQ ID NO: 75244 - RNA, 27 nt, Artificial Sequence
  Dolichyl-diphosphooligosaccharide-proteinosyltransferase subunit 2 (190-198)
agacuggacgagcucggcgggguguac

SEQ ID NO: 75245 - RNA, 27 nt, Artificial Sequence
  Activating signal cointegrator 1 (224-232)
agacuggacgagaccauccaggccauu

SEQ ID NO: 75246 - RNA, 27 nt, Artificial Sequence
  Helicase-like transcription factor (880-888)
agacuggacggcagcauggcccagaag

SEQ ID NO: 75247 - RNA, 27 nt, Artificial Sequence
  Tubulin alpha-1C chain (355-363)
agacuggaccacaaguucgaucucaug

SEQ ID NO: 75248 - RNA, 27 nt, Artificial Sequence
  Protein kinase C and casein kinase substrate in neurons protein 2 (427-435)
agacuggacaacggccagguggggcuc

SEQ ID NO: 75249 - RNA, 27 nt, Artificial Sequence
  Coiled-coil domain-containing protein 138 (306-314)
agacuggacaaccuccagaggaaguac

SEQ ID NO: 75250 - RNA, 27 nt, Artificial Sequence
  Melanoma antigen preferentially expressed in tumors (312-320)
agacuggaccagcuccuuaggcacgug

SEQ ID NO: 75251 - RNA, 27 nt, Artificial Sequence
  Coiled-coil domain-containing protein 91 (405-413)
agacuggaccaggugaucaggcaacgg

SEQ ID NO: 75252 - RNA, 33 nt, Artificial Sequence
  Nicastrin (281-291)
agacuggacagcagguccuucuuuuggaacgug

SEQ ID NO: 75253 - RNA, 27 nt, Artificial Sequence
  C-Jun-amino-terminal kinase-interacting protein 4 (1097-1105)
agacuggacagcacccucaggcuuuac

SEQ ID NO: 75254 - RNA, 27 nt, Artificial Sequence
  Cyclin-dependent kinase 2 (36-44)
agacuggacaccgagacagaaggcgug

SEQ ID NO: 75255 - RNA, 27 nt, Artificial Sequence
  Uncharacterized protein C19orf60 (50-58)
agacuggaggaaggccacaggcaguac

SEQ ID NO: 75256 - RNA, 30 nt, Artificial Sequence
  Cap-specific mRNAucleoside-2'-O-)-methyltransferase 1 (708-717)
agacuggaggaaauggagaagaucuucgug

SEQ ID NO: 75257 - RNA, 33 nt, Artificial Sequence
  Pre-mRNA-processing factor 6 (317-327)
agacuggaggaagugaccggcaagcuccagguc

SEQ ID NO: 75258 - RNA, 30 nt, Artificial Sequence
  Armadillo repeat-containing protein 8 (27-36)
agacuguucgaccccgauccucagaaggug

SEQ ID NO: 75259 - RNA, 30 nt, Artificial Sequence
  Receptor-interacting serine/threonine-protein kinase 4 (198-207)
agacuguucgacaccaagcacgauguguac

SEQ ID NO: 75260 - RNA, 30 nt, Artificial Sequence
  Phosphatidylinositol 4-kinase beta (132-141)
agacuguucgagagcaagcucuuugacauc

SEQ ID NO: 75261 - RNA, 30 nt, Artificial Sequence
  Cartilage-associated protein (107-116)
agacuguucggcgggcuccuuaggcgggcc

SEQ ID NO: 75262 - RNA, 30 nt, Artificial Sequence
  Synaptonemal complex protein SC65 (104-113)
agacuguucggcagggugcucgagcgggcc

SEQ ID NO: 75263 - RNA, 36 nt, Artificial Sequence
  Diamine acetyltransferase 1 (155-166)
agacuguucaagaucgacaaagaguaccuccuuaag

SEQ ID NO: 75264 - RNA, 33 nt, Artificial Sequence
  Dol-P-Man:Man(5)GlcNAc(2)-PP-Dol alpha-1,3-mannosyltransferase (123-133)
agacuguucaacgaccccguggccaugguccuc

SEQ ID NO: 75265 - RNA, 27 nt, Artificial Sequence
  Membralin (58-66)
agacuguuccccccugccuuuaggcgg

SEQ ID NO: 75266 - RNA, 27 nt, Artificial Sequence
  DNA primase small subunit (19-27)
agacuguuccccuacagccaguauuac

SEQ ID NO: 75267 - RNA, 27 nt, Artificial Sequence
  Homeobox protein cut-like 1 (640-648)
agacuguuccaggaggugcccaagagg

SEQ ID NO: 75268 - RNA, 33 nt, Artificial Sequence
  Coatomer subunit gamma-2 (75-85)
agacuguuccagagcaacgaccaaacccucagg

SEQ ID NO: 75269 - RNA, 27 nt, Artificial Sequence
  28S ribosomal protein S2, mitochondrial (251-259)
agacuguuccagaccgccaucacaagg

SEQ ID NO: 75270 - RNA, 27 nt, Artificial Sequence
  Armadillo repeat-containing protein 2 (134-142)
agacuguucagggccgcuagccagcgg

SEQ ID NO: 75271 - RNA, 30 nt, Artificial Sequence
  Nicalin (40-49)
agacuguucagcaggcucuacaccuauaag

SEQ ID NO: 75272 - RNA, 36 nt, Artificial Sequence
  C-Jun-amino-terminal kinase-interacting protein 4 (548-559)
agacuguucagcuccucuucaaacaccacaaagaaa

SEQ ID NO: 75273 - RNA, 30 nt, Artificial Sequence
  40S ribosomal protein S17 (23-32)
agacugggcaacgacuuccacaccaauaag

SEQ ID NO: 75274 - RNA, 30 nt, Artificial Sequence
  Thrombospondin-2 (245-254)
agacugggcccccacgugaccacagaguac

SEQ ID NO: 75275 - RNA, 27 nt, Artificial Sequence
  Ankyrin repeat domain-containing protein 54 (100-108)
agacugggccccaccgggaaggaggug

SEQ ID NO: 75276 - RNA, 30 nt, Artificial Sequence
  Protein fantom (56-65)
agacugcacgacgagaacauccuccuuaag

SEQ ID NO: 75277 - RNA, 39 nt, Artificial Sequence
  40S ribosomal protein S20 (87-99)
agacugaucgaccuccacagccccuccgagauugugaag

SEQ ID NO: 75278 - RNA, 33 nt, Artificial Sequence
  28S ribosomal protein S5, mitochondrial (246-256)
agacugaucggcauuaaggacauguacgccaaa

SEQ ID NO: 75279 - RNA, 27 nt, Artificial Sequence
  Abnormal spindle-like microcephaly-associated protein (521-529)
agacugauccagaccacauggaggaag

SEQ ID NO: 75280 - RNA, 27 nt, Artificial Sequence
  Calcineurin-binding protein cabin-1 (136-144)
agacugaucaggauuccccucgcccgg

SEQ ID NO: 75281 - RNA, 33 nt, Artificial Sequence
  Chromatin assembly factor 1 subunit A (782-792)
agacugaucagcgagaacuccguguacgaaaag

SEQ ID NO: 75282 - RNA, 27 nt, Artificial Sequence
  Rho guanine nucleotide exchange factor 39 (185-193)
agacugaucagcgagaccgcccagagg

SEQ ID NO: 75283 - RNA, 36 nt, Artificial Sequence
  DCN1-like protein 5 (40-51)
agacugaucagcggcgaggaacacuucuccucuaag

SEQ ID NO: 75284 - RNA, 36 nt, Artificial Sequence
  40S ribosomal protein S4, X isoform (81-92)
agacugaucuacgacaccaagggcagguucgccgug

SEQ ID NO: 75285 - RNA, 27 nt, Artificial Sequence
  Protein PRRC2A (2074-2082)
agacugaaggccacccccagcacauac

SEQ ID NO: 75286 - RNA, 27 nt, Artificial Sequence
  Nuclear migration protein nudC (143-151)
agacugaagggcaaagacauggugguc

SEQ ID NO: 75287 - RNA, 33 nt, Artificial Sequence
  tRNA-splicing endonuclease subunit Sen34 (58-68)
agacugcucgccgagaucggcgcugugacccuu

SEQ ID NO: 75288 - RNA, 27 nt, Artificial Sequence
  Transcription factor SPT20 homolog (262-270)
agacugcucgacuuccuucagaagagg

SEQ ID NO: 75289 - RNA, 27 nt, Artificial Sequence
  Mitogen-activated protein kinase-binding protein 1 (92-100)
agacugcucgacaaguggguggagcuu

SEQ ID NO: 75290 - RNA, 27 nt, Artificial Sequence
  E3 ubiquitin-protein ligase RNF14 (373-381)
agacugcucgaccagagguacggcaag

SEQ ID NO: 75291 - RNA, 33 nt, Artificial Sequence
  Lysine-specific histone demethylase 1A (408-418)
agacugcucgaggccaccagcuaccuuucccac

SEQ ID NO: 75292 - RNA, 27 nt, Artificial Sequence
  39S ribosomal protein L37, mitochondrial (112-120)
agacugcucgagggcgugaagcaggcc

SEQ ID NO: 75293 - RNA, 27 nt, Artificial Sequence
  Transient receptor potential cation channel subfamily M member 1 (158-166)
agacugcucgagaagcacaucagccuu

SEQ ID NO: 75294 - RNA, 27 nt, Artificial Sequence
  DNA-directed RNA polymerase III subunit RPC3 (458-466)
agacugcucgagaagagccagagggug

SEQ ID NO: 75295 - RNA, 27 nt, Artificial Sequence
  citron Rho-interacting kinase isoform X13 (384-392)
agacugcucgagcuugaaaccaggcug

SEQ ID NO: 75296 - RNA, 27 nt, Artificial Sequence
  Clathrin heavy chain 1 (583-591)
agacugcucgagaugaaccuuaugcac

SEQ ID NO: 75297 - RNA, 33 nt, Artificial Sequence
  Unconventional myosin-Va (137-147)
agacugcucgagagccagcuucaaucccagaag

SEQ ID NO: 75298 - RNA, 33 nt, Artificial Sequence
  Glycogen synthase kinase-3 beta (319-329)
agacugcucgaguacacccccacagccaggcuu

SEQ ID NO: 75299 - RNA, 51 nt, Artificial Sequence
  Oxidation resistance protein 1 (21-37)
agacugcucggcuucgggggagguggcgaggccaggcagacccuugcuaag

SEQ ID NO: 75300 - RNA, 24 nt, Artificial Sequence
  Membrane-associated transporter protein (209-216)
agacugcucggcaccgaguuccag

SEQ ID NO: 75301 - RNA, 27 nt, Artificial Sequence
  Microsomal glutathione S-transferase 1 (147-155)
agacugcucaagagcaaacuuuaccug

SEQ ID NO: 75302 - RNA, 27 nt, Artificial Sequence
  Actin-binding protein anillin (762-770)
agacugcuccuuaucgccaccggcaag

SEQ ID NO: 75303 - RNA, 30 nt, Artificial Sequence
  DNA replication licensing factor MCM6 (11-20)
agacugcucaacaagagcaucauuagggug

SEQ ID NO: 75304 - RNA, 33 nt, Artificial Sequence
  Activating signal cointegrator 1 complex subunit 3 (832-842)
agacugcucaaccuuagcaaggugaucgacaaa

SEQ ID NO: 75305 - RNA, 33 nt, Artificial Sequence
  Glioma tumor suppressor candidate region gene 2 protein (165-175)
agacugcucaaccccagcgccaccagggcuaag

SEQ ID NO: 75306 - RNA, 30 nt, Artificial Sequence
  Ectonucleoside triphosphate diphosphohydrolase 6 (169-178)
agacugcuccccggcgagaaggcccagaaa

SEQ ID NO: 75307 - RNA, 33 nt, Artificial Sequence
  Myomegalin (2291-2301)
agacugcuccagagcaccacagagcaccuuaag

SEQ ID NO: 75308 - RNA, 27 nt, Artificial Sequence
  Carbohydrate sulfotransferase 14 (180-188)
agacugcucagcgccuacaggaacaag

SEQ ID NO: 75309 - RNA, 36 nt, Artificial Sequence
  GPI-anchor transamidase (149-160)
agacugcucagcgacgauagguccaacauccuuauu

SEQ ID NO: 75310 - RNA, 30 nt, Artificial Sequence
  Spermatogenesis-associated protein 20 (128-137)
agacugcucagcgaggacuucguguccguc

SEQ ID NO: 75311 - RNA, 33 nt, Artificial Sequence
  Attractin (51-61)
agacugcucagccccccucuuaggccacggcug

SEQ ID NO: 75312 - RNA, 36 nt, Artificial Sequence
  Attractin (51-62)
agacugcucagccccccucuuaggccacggcuguug

SEQ ID NO: 75313 - RNA, 27 nt, Artificial Sequence
  Actin-binding protein anillin (910-918)
agacugcucaccagcaucacaacuaag

SEQ ID NO: 75314 - RNA, 33 nt, Artificial Sequence
  Serine/threonine-protein kinase mTOR (2429-2439)
agacugauggacaccaacacaaagggcaauaaa

SEQ ID NO: 75315 - RNA, 33 nt, Artificial Sequence
  Dehydrodolichyl diphosphate syntase complex subunit DHDDS (103-113)
agacugauggaggaaaaggagaaacuccagaag

SEQ ID NO: 75316 - RNA, 27 nt, Artificial Sequence
  Dedicator of cytokinesis protein 4 (213-221)
agacugauggagaggcuccuugacuac

SEQ ID NO: 75317 - RNA, 27 nt, Artificial Sequence
  Nuclear receptor-interacting protein 3 (4-12)
agacugauggagaccaaccucagcaag

SEQ ID NO: 75318 - RNA, 36 nt, Artificial Sequence
  Heterogeneous nuclear ribonucleoprotein Q (192-203)
agacugaugauggacccccucaccggccuuaacagg

SEQ ID NO: 75319 - RNA, 33 nt, Artificial Sequence
  Heat shock protein 105 kDa (169-179)
agacugaugaacgacaugaccgccguggcucuc

SEQ ID NO: 75320 - RNA, 27 nt, Artificial Sequence
  RILP-like protein 1 (52-60)
agacugaugcccaagguggucaggguu

SEQ ID NO: 75321 - RNA, 27 nt, Artificial Sequence
  U5 small nuclear ribonucleoprotein 200 kDa helicase (841-849)
agacugaugagggccaucuucgagauu

SEQ ID NO: 75322 - RNA, 27 nt, Artificial Sequence
  FYVE, RhoGEF and PH domain-containing protein 4 (32-40)
agacugaugagcaagaacuucaccaaa

SEQ ID NO: 75323 - RNA, 27 nt, Artificial Sequence
  Hyaluronan mediated motility receptor (119-127)
agacugaacgccgcucucagggagaag

SEQ ID NO: 75324 - RNA, 27 nt, Artificial Sequence
  Cytochrome c oxidase subunit 5A, mitochondrial (98-106)
agacugaacgacuucgccagcaccgug

SEQ ID NO: 75325 - RNA, 27 nt, Artificial Sequence
  Spectrin beta chain, non-erythrocytic 1 (2278-2286)
agacugaacgacggcaaugaguaccuc

SEQ ID NO: 75326 - RNA, 30 nt, Artificial Sequence
  V-type proton ATPase subunit H (382-391)
agacugaacgagaagaauuacgaacuccuu

SEQ ID NO: 75327 - RNA, 33 nt, Artificial Sequence
  Pyruvate kinase PKM (73-83)
agacugaacuucagccacggcacccaugaguac

SEQ ID NO: 75328 - RNA, 36 nt, Artificial Sequence
  60S acidic ribosomal protein P2 (38-49)
agacugaacaaggugaucagcgagcucaauggcaaa

SEQ ID NO: 75329 - RNA, 27 nt, Artificial Sequence
  Midasin (2183-2191)
agacugaacaauaagaucaacagcuac

SEQ ID NO: 75330 - RNA, 33 nt, Artificial Sequence
  RalBP1-associated Eps domain-containing protein 1 (712-722)
agacugaacagcgagcuccagcaacagcuuaag

SEQ ID NO: 75331 - RNA, 30 nt, Artificial Sequence
  Testis-expressed sequence 10 protein (473-482)
agacugaacagcaagcagcucaauaggcuu

SEQ ID NO: 75332 - RNA, 30 nt, Artificial Sequence
  Integrator complex subunit 8 (649-658)
agacugcccgacaucccucucaggcaggug

SEQ ID NO: 75333 - RNA, 33 nt, Artificial Sequence
  Protrudin (48-58)
agacugcccgacagcgagcucaugaggcggaag

SEQ ID NO: 75334 - RNA, 33 nt, Artificial Sequence
  Beta-1,3-N-acetylglucosaminyltransferase radical fringe (267-277)
agacugcccccugacacccuccuucagcaagug

SEQ ID NO: 75335 - RNA, 27 nt, Artificial Sequence
  F-actin-capping protein subunit beta (41-49)
agacugcccccucagcaaaucgagaag

SEQ ID NO: 75336 - RNA, 39 nt, Artificial Sequence
  Transmembrane protein 51 (123-135)
agacugccccagggcaccauguucccugccacaaggaag

SEQ ID NO: 75337 - RNA, 27 nt, Artificial Sequence
  Inactive tyrosine-protein kinase 7 (362-370)
agacugcccacccacggcaggguguac

SEQ ID NO: 75338 - RNA, 27 nt, Artificial Sequence
  Bridging integrator 3 (137-145)
agacugcaggccaagguggagaaauac

SEQ ID NO: 75339 - RNA, 30 nt, Artificial Sequence
  Nck-associated protein 1 (492-501)
agacugcaggccuacaccagcguguccaag

SEQ ID NO: 75340 - RNA, 27 nt, Artificial Sequence
  Scavenger receptor class A member 5 (244-252)
agacugcaggaccucagggugcuuguc

SEQ ID NO: 75341 - RNA, 39 nt, Artificial Sequence
  Protein FAM167A (131-143)
agacugcaggaccaacagcucgccaggcagcuuaugcgg

SEQ ID NO: 75342 - RNA, 30 nt, Artificial Sequence
  KH domain-containing, RNA-binding, signal transduction-associated protein 1 (186-195)
agacugcaggaggaaaccggcgccaagauc

SEQ ID NO: 75343 - RNA, 27 nt, Artificial Sequence
  26S proteasome non-ATPase regulatory subunit 12 (39-47)
agacugcaggaggugaucgaaacccuc

SEQ ID NO: 75344 - RNA, 33 nt, Artificial Sequence
  Sentrin-specific protease 6 (172-182)
agacugcagggcguggagaggaucaugaagaaa

SEQ ID NO: 75345 - RNA, 36 nt, Artificial Sequence
  60S ribosomal protein L10 (109-120)
agacugcagaccggcaugaggggggccuucggaaag

SEQ ID NO: 75346 - RNA, 30 nt, Artificial Sequence
  Integrin beta-3 (117-126)
agacugaggcccgacgauagcaagaacuuc

SEQ ID NO: 75347 - RNA, 30 nt, Artificial Sequence
  Protogenin (10-19)
agacugaggcccccuggcaugcuccuucgg

SEQ ID NO: 75348 - RNA, 33 nt, Artificial Sequence
  DNA replication licensing factor MCM5 (573-583)
agacugagcgccgaggcugcagaaaagcucaaa

SEQ ID NO: 75349 - RNA, 36 nt, Artificial Sequence
  EF-hand domain-containing protein D2 (176-187)
agacugagcgagaucgacguguccucugaaggcguc

SEQ ID NO: 75350 - RNA, 27 nt, Artificial Sequence
  MICOS complex subunit MIC25 (29-37)
agacugagcgagaacguggucaauagg

SEQ ID NO: 75351 - RNA, 27 nt, Artificial Sequence
  Neuron navigator 2 (2169-2177)
agacugagcgaguacaucgugcucagg

SEQ ID NO: 75352 - RNA, 33 nt, Artificial Sequence
  Serine palmitoyltransferase 2 (212-222)
agacugagcggcgccaccaucaggauuuucaag

SEQ ID NO: 75353 - RNA, 27 nt, Artificial Sequence
  T-complex protein 1 subunit delta (435-443)
agacugaccgaguacagcaggacacuc

SEQ ID NO: 75354 - RNA, 27 nt, Artificial Sequence
  60S ribosomal protein L36 (32-40)
agacugaccaagcacacaaaauucgug

SEQ ID NO: 75355 - RNA, 27 nt, Artificial Sequence
  Centromere protein F (420-428)
agacugacccaggagcuccaacaggcc

SEQ ID NO: 75356 - RNA, 30 nt, Artificial Sequence
  Spectrin beta chain, non-erythrocytic 1 (2078-2087)
agacugaccacacucgagcuucuggaagug

SEQ ID NO: 75357 - RNA, 39 nt, Artificial Sequence
  Disintegrin and metalloproteinase domain-containing protein 10 (389-401)
agacugguggacgccgauggcccccucgcuaggcuuaag

SEQ ID NO: 75358 - RNA, 33 nt, Artificial Sequence
  DNA mismatch repair protein Mlh1 (265-275)
agacugguggagagcaccucccucaggaaggcc

SEQ ID NO: 75359 - RNA, 27 nt, Artificial Sequence
  Coiled-coil domain-containing protein 144A (749-757)
agacuggugaaggagcucaggaccguc

SEQ ID NO: 75360 - RNA, 39 nt, Artificial Sequence
  Sialidase-3 (111-123)
agacuggugagcaacuccuggacccaggccauccucaag

SEQ ID NO: 75361 - RNA, 27 nt, Artificial Sequence
  Uridine phosphorylase 1 (90-98)
agacuggugagcuacuucaucaagaaa

SEQ ID NO: 75362 - RNA, 27 nt, Artificial Sequence
  Cryptochrome-2 (155-163)
agacugugggaccucuacaagaaagug

SEQ ID NO: 75363 - RNA, 45 nt, Artificial Sequence
  Ribosome biogenesis protein WDR12 (322-336)
agacugugggaccccaggaccaaggauggcagccucgugucccuu

SEQ ID NO: 75364 - RNA, 30 nt, Artificial Sequence
  Protein polybromo-1 (982-991)
agacugugggaggacagcgccggcgaaaag

SEQ ID NO: 75365 - RNA, 27 nt, Artificial Sequence
  ATP-dependent RNA helicase DDX24 (447-455)
agacugugggagcucaucaaggaaaaa

SEQ ID NO: 75366 - RNA, 30 nt, Artificial Sequence
  DnaJ homolog subfamily C member 4 (11-20)
agacuguggcccaggaacccuccaagccgg

SEQ ID NO: 75367 - RNA, 36 nt, Artificial Sequence
  Multifunctional protein ADE2 (215-226)
agacuguggcccagcggcgacaggucccagcaaaag

SEQ ID NO: 75368 - RNA, 33 nt, Artificial Sequence
  39S ribosomal protein L37, mitochondrial (162-172)
agacuguggcagaccacagaggaaauccccaag

SEQ ID NO: 75369 - RNA, 30 nt, Artificial Sequence
  Protein phosphatase Slingshot homolog 1 (144-153)
agacuguggagcgacaccaagauccaccuc

SEQ ID NO: 75370 - RNA, 30 nt, Artificial Sequence
  Inositol 1,4,5-trisphosphate receptor type 1 (806-815)
agacuguggagcgagauccccuccgaaauu

SEQ ID NO: 75371 - RNA, 30 nt, Artificial Sequence
  E3 ubiquitin-protein ligase Mdm2 (71-80)
agacuguacgacgagaagcagcaacacauc

SEQ ID NO: 75372 - RNA, 36 nt, Artificial Sequence
  E3 ubiquitin-protein ligase Mdm2 (65-76)
agacuguacgacgagaagcagcaacacaucguguau

SEQ ID NO: 75373 - RNA, 33 nt, Artificial Sequence
  ATP-binding cassette sub-family B member 10, mitochondrial (542-552)
agacuguacgaccccgccagcggcaccaucucc

SEQ ID NO: 75374 - RNA, 30 nt, Artificial Sequence
  MICOS complex subunit MIC26 (165-174)
agacuguacgacuggggccucaggggguau

SEQ ID NO: 75375 - RNA, 27 nt, Artificial Sequence
  ADP-ribosylation factor-like protein 4D (182-190)
agacuguacgagaugauccucaagagg

SEQ ID NO: 75376 - RNA, 39 nt, Artificial Sequence
  Probable fibrosin-1 (306-318)
agacuguacggccucgagcccgcccacccucuucuguau

SEQ ID NO: 75377 - RNA, 30 nt, Artificial Sequence
  Tubulin-specific chaperone C (217-226)
agacuguacggcaaccccaauacccucagg

SEQ ID NO: 75378 - RNA, 27 nt, Artificial Sequence
  Tubulin polyglutamylase TTLL7 (399-407)
agacuguacggccagaacagcaucaag

SEQ ID NO: 75379 - RNA, 27 nt, Artificial Sequence
  Condensin-2 complex subunit G2 (329-337)
agacuguacaagcccauccucuggagg

SEQ ID NO: 75380 - RNA, 27 nt, Artificial Sequence
  Partitioning defective 6 homolog beta (159-167)
agacuguacaaguauggcaccgagaaa

SEQ ID NO: 75381 - RNA, 30 nt, Artificial Sequence
  HCG2002594, isoform CRA_c (311-320)
agacuguaccccuggggcaucguggagguc

SEQ ID NO: 75382 - RNA, 24 nt, Artificial Sequence
  Conserved oligomeric Golgi complex subunit 4 (121-128)
agacuguaccaggccauccaaagg

SEQ ID NO: 75383 - RNA, 33 nt, Artificial Sequence
  Proteasome subunit alpha type-7 (143-153)
agacuguaccagaccgaccccagcggcacauau

SEQ ID NO: 75384 - RNA, 27 nt, Artificial Sequence
  Coiled-coil domain-containing protein 77 (127-135)
agacuguacagcgagaacgacaggcuc

SEQ ID NO: 75385 - RNA, 30 nt, Artificial Sequence
  39S ribosomal protein L17, mitochondrial (74-83)
agaauggccgacuucuggcugaccgagaag

SEQ ID NO: 75386 - RNA, 39 nt, Artificial Sequence
  Coiled-coil-helix-coiled-coil-helix domain-containing protein 2 (11-23)
agaauggcccccccugcuagcagggcaccacagaugcgg

SEQ ID NO: 75387 - RNA, 27 nt, Artificial Sequence
  Exportin-1 (44-52)
agaauggcccaggaggugcugacccac

SEQ ID NO: 75388 - RNA, 30 nt, Artificial Sequence
  Lon protease homolog 2, peroxisomal (632-641)
agaauggacggcgaggggcagcugacccuc

SEQ ID NO: 75389 - RNA, 27 nt, Artificial Sequence
  DNA mismatch repair protein Msh3 (448-456)
agaauggacaacaucuacuucgaguau

SEQ ID NO: 75390 - RNA, 36 nt, Artificial Sequence
  39S ribosomal protein L51, mitochondrial (101-112)
agaauguucgccgacgaucugcacaaccucaauaag

SEQ ID NO: 75391 - RNA, 33 nt, Artificial Sequence
  60S ribosomal protein L4 (100-110)
agaauguucgcccccaccaagacauggaggcgg

SEQ ID NO: 75392 - RNA, 27 nt, Artificial Sequence
  Zinc finger BED domain-containing protein 5 (228-236)
agaauguucgacgagcaguacagcaag

SEQ ID NO: 75393 - RNA, 33 nt, Artificial Sequence
  HLA class II histocompatibility antigen, DP alpha 1 chain (6-16)
agaauguuccacaucagggccgugauucugcgg

SEQ ID NO: 75394 - RNA, 30 nt, Artificial Sequence
  Protein Shroom2 (323-332)
agaauguucaucggcgaccuggauaaggug

SEQ ID NO: 75395 - RNA, 30 nt, Artificial Sequence
  Cullin-1 (506-515)
agaauguuccaggacaucggcgugagcaag

SEQ ID NO: 75396 - RNA, 36 nt, Artificial Sequence
  EPM2A-interacting protein 1 (249-260)
agaaugaucggcgagaacagcgggcugguguccuac

SEQ ID NO: 75397 - RNA, 30 nt, Artificial Sequence
  Leucine-rich repeat and WD repeat-containing protein 1 (193-202)
agaaugaucagcgaggaacugguggccgcu

SEQ ID NO: 75398 - RNA, 30 nt, Artificial Sequence
  Endoplasmin (509-518)
agaaugaaggagaaacaggacaagaucuac

SEQ ID NO: 75399 - RNA, 33 nt, Artificial Sequence
  Heat shock protein HSP 90-alpha (605-615)
agaaugaaggagaaccagaaacacaucuacuau

SEQ ID NO: 75400 - RNA, 30 nt, Artificial Sequence
  Heat shock protein HSP 90-beta (401-410)
agaaugaaggagacccagaaaagcaucuac

SEQ ID NO: 75401 - RNA, 33 nt, Artificial Sequence
  Heat shock protein HSP 90-beta (401-411)
agaaugaaggagacccagaaaagcaucuacuau

SEQ ID NO: 75402 - RNA, 30 nt, Artificial Sequence
  60S ribosomal protein L39 (28-37)
agaaugaagaccggcaacaaaaucagguac

SEQ ID NO: 75403 - RNA, 27 nt, Artificial Sequence
  Liprin-alpha-4 (339-347)
agaaugcuggaccaccucaccaagaaa

SEQ ID NO: 75404 - RNA, 30 nt, Artificial Sequence
  Eukaryotic translation initiation factor 3 subunit A (752-761)
agaaugcuggaggacagggaucucuucgug

SEQ ID NO: 75405 - RNA, 27 nt, Artificial Sequence
  Proteasome subunit beta type-7 (103-111)
agaaugcugaagcagaugcucuucagg

SEQ ID NO: 75406 - RNA, 33 nt, Artificial Sequence
  cDNA FLJ78342 (112-122)
agaaugcugcagaucagcgaguccucuuuccuc

SEQ ID NO: 75407 - RNA, 33 nt, Artificial Sequence
  rRNA-processing protein FCF1 homolog (15-25)
agaaugcugagccucagggaccagcggcuuaag

SEQ ID NO: 75408 - RNA, 30 nt, Artificial Sequence
  Meiotic nuclear division protein 1 homolog (15-24)
agaaugauggagaucuucagcgaaaccaag

SEQ ID NO: 75409 - RNA, 33 nt, Artificial Sequence
  Zinc finger FYVE domain-containing protein 16 (812-822)
agaaugaugagccccaccggcuccaaccugaag

SEQ ID NO: 75410 - RNA, 27 nt, Artificial Sequence
  DNA replication ATP-dependent helicase/nuclease DNA2 (828-836)
agaaugaacagcaagaucaugucccug

SEQ ID NO: 75411 - RNA, 33 nt, Artificial Sequence
  WAS protein family homolog 1 (5-15)
agaaugcagcacagccuggccggccaaaccuac

SEQ ID NO: 75412 - RNA, 27 nt, Artificial Sequence
  Neuron navigator 2 (1941-1949)
agaaugcagagcgagaucgaaaagcug

SEQ ID NO: 75413 - RNA, 27 nt, Artificial Sequence
  28 kDa heat- and acid-stable phosphoprotein (173-181)
agaaugcagagccugucccucaacaag

SEQ ID NO: 75414 - RNA, 39 nt, Artificial Sequence
  cDNA FLJ57726, highly similar to Heterogeneous nuclear ribonucleoprotein H3 (32-44)
agaaugagggacggccgggggaugggaggucacggcuac

SEQ ID NO: 75415 - RNA, 27 nt, Artificial Sequence
  Histone-lysine N-methyltransferase EHMT2 (42-50)
agaaugagcgacgaugugcacucccug

SEQ ID NO: 75416 - RNA, 27 nt, Artificial Sequence
  La-related protein 4 (502-510)
agaaugagcgacguggucaagggcguu

SEQ ID NO: 75417 - RNA, 48 nt, Artificial Sequence
  Casein kinase I isoform delta (394-409)
agaaugagcaccucccagaacucuauccccuucgagcaccauggcaag

SEQ ID NO: 75418 - RNA, 27 nt, Artificial Sequence
  Nucleophosmin (277-285)
agaaugaccgaccaggaggccauccaa

SEQ ID NO: 75419 - RNA, 30 nt, Artificial Sequence
  DNA mismatch repair protein Msh6 (302-311)
agaauggugaccggcaacgggagccugaag

SEQ ID NO: 75420 - RNA, 33 nt, Artificial Sequence
  Mesencephalic astrocyte-derived neurotrophic factor (3-13)
agaaugugggccacccagggccuggcuguggca

SEQ ID NO: 75421 - RNA, 27 nt, Artificial Sequence
  Arginine/serine-rich coiled-coil protein 2 (170-178)
agaaaccuggacgcccaguacgagaug

SEQ ID NO: 75422 - RNA, 51 nt, Artificial Sequence
  Melanocyte protein PMEL (241-257)
agaaaccagccccugaccuucgcccuccaacuucacgacccuagcggcuac

SEQ ID NO: 75423 - RNA, 27 nt, Artificial Sequence
  Keratin, type I cytoskeletal 10 (99-107)
agaaacgugagcaccggcgacgucaau

SEQ ID NO: 75424 - RNA, 27 nt, Artificial Sequence
  Dystonin (4836-4844)
agacaggccgaggaauuccacagcgug

SEQ ID NO: 75425 - RNA, 27 nt, Artificial Sequence
  Stathmin-3 (130-138)
agacaggccgaggaaaagcugaacuac

SEQ ID NO: 75426 - RNA, 27 nt, Artificial Sequence
  Elongation factor 1-gamma (99-107)
agacaggccuuccccaacaccaauagg

SEQ ID NO: 75427 - RNA, 27 nt, Artificial Sequence
  A-kinase anchor protein 10, mitochondrial (481-489)
agacaggccuggaccacaauggagaag

SEQ ID NO: 75428 - RNA, 27 nt, Artificial Sequence
  Vimentin (207-215)
agacaggacguggauaacgccagccug

SEQ ID NO: 75429 - RNA, 27 nt, Artificial Sequence
  Acidic fibroblast growth factor intracellular-binding protein (136-144)
agacaguucgacaacuuuaagagggug

SEQ ID NO: 75430 - RNA, 24 nt, Artificial Sequence
  Lysine-specific demethylase 5B (878-885)
agacaguucgugacccaacuguac

SEQ ID NO: 75431 - RNA, 27 nt, Artificial Sequence
  Fibronectin type III domain-containing protein 3B (198-206)
agacagaucgacaggcaaaaccggcug

SEQ ID NO: 75432 - RNA, 30 nt, Artificial Sequence
  Cytochrome P450 2U1 (288-297)
agacagaucgagaaggacauuaccagcuuc

SEQ ID NO: 75433 - RNA, 24 nt, Artificial Sequence
  Interferon alpha-inducible protein 6 (2-9)
agacagaaggccgugagccuguuc

SEQ ID NO: 75434 - RNA, 27 nt, Artificial Sequence
  THAP domain-containing protein 1 (175-183)
agacagcuggagaagcucaaagaagug

SEQ ID NO: 75435 - RNA, 33 nt, Artificial Sequence
  3-hydroxy-3-methylglutaryl-coenzyme A reductase (84-94)
agacagcugggcagcaaguacauccucgggauu

SEQ ID NO: 75436 - RNA, 27 nt, Artificial Sequence
  Protein FAM32A (72-80)
agacagauggagaggauccugaagaaa

SEQ ID NO: 75437 - RNA, 27 nt, Artificial Sequence
  Splicing factor 3A subunit 1 (72-80)
agacagaacgagaucaauaaccccaag

SEQ ID NO: 75438 - RNA, 27 nt, Artificial Sequence
  Spectrin beta chain, non-erythrocytic 1 (1161-1169)
agacagaaccugcucagccaaucccac

SEQ ID NO: 75439 - RNA, 27 nt, Artificial Sequence
  Unconventional myosin-X (252-260)
agacagaaccccggcgagaggaauuac

SEQ ID NO: 75440 - RNA, 30 nt, Artificial Sequence
  Phosphatidylinositol-binding clathrin assembly protein (139-148)
agacagguggccuucgacuuuaccaagguc

SEQ ID NO: 75441 - RNA, 27 nt, Artificial Sequence
  Hom s 2 (98-106)
agacaggugaccggcgucacaaggguu

SEQ ID NO: 75442 - RNA, 30 nt, Artificial Sequence
  Alpha-actinin-1 (672-681)
agacaguacgagaagagcaucgugaacuau

SEQ ID NO: 75443 - RNA, 27 nt, Artificial Sequence
  Protein CREG2 (251-259)
agacaguacgagugguucuuuaugaag

SEQ ID NO: 75444 - RNA, 27 nt, Artificial Sequence
  Transmembrane emp24 domain-containing protein 4 (92-100)
agacaguacggcagcgaggggagguuc

SEQ ID NO: 75445 - RNA, 27 nt, Artificial Sequence
  Bromodomain adjacent to zinc finger domain protein 2B (487-495)
agacaguaccccgaggugaucaaguau

SEQ ID NO: 75446 - RNA, 27 nt, Artificial Sequence
  Myb-binding protein 1A (59-67)
agaagggacuuccagauccgggugcug

SEQ ID NO: 75447 - RNA, 27 nt, Artificial Sequence
  FLYWCH-type zinc finger-containing protein 1 (137-145)
agaaggggccccgggccucugacccuc

SEQ ID NO: 75448 - RNA, 27 nt, Artificial Sequence
  NEDD8 ultimate buster 1 (431-439)
agaaggcuggagaacauccgguuccuc

SEQ ID NO: 75449 - RNA, 27 nt, Artificial Sequence
  Tribbles homolog 2 (31-39)
agaagcgccgagcccucccagucuuuc

SEQ ID NO: 75450 - RNA, 27 nt, Artificial Sequence
  Adenylate kinase 2, mitochondrial (175-183)
agaagcgacgauaacgagaaggcccug

SEQ ID NO: 75451 - RNA, 33 nt, Artificial Sequence
  Rhomboid-like protein (64-74)
agaagcgaccccggcaccuccggggaggccuac

SEQ ID NO: 75452 - RNA, 33 nt, Artificial Sequence
  THO complex subunit 5 homolog (27-37)
agaagcgacaccgagcaggaaggcaaguacuau

SEQ ID NO: 75453 - RNA, 27 nt, Artificial Sequence
  Serine/threonine-protein kinase VRK2 (112-120)
agaagcgacguggagauccugggcuac

SEQ ID NO: 75454 - RNA, 39 nt, Artificial Sequence
  Eukaryotic translation initiation factor 3 subunit E (431-443)
agaagcgaggcccccaacugggcuacccaggacuccggc

SEQ ID NO: 75455 - RNA, 39 nt, Artificial Sequence
  Annexin A1 (303-315)
agaagcgagaucgacaugaacgauauuaaggccuucuac

SEQ ID NO: 75456 - RNA, 30 nt, Artificial Sequence
  Protein LAP2 (1012-1021)
agaagcgaguccaccgaaaaccagucuuac

SEQ ID NO: 75457 - RNA, 27 nt, Artificial Sequence
  Zinc finger and BTB domain-containing protein 17 (362-370)
agaagcuucuccgaccccaccucuaag

SEQ ID NO: 75458 - RNA, 33 nt, Artificial Sequence
  Acyl-coenzyme A thioesterase THEM4 (34-44)
agaagcuucuccucugaggaagugauccugaag

SEQ ID NO: 75459 - RNA, 27 nt, Artificial Sequence
  Hypoxia-inducible factor 1-alpha (30-38)
agaagcaaggaguccgaaguguucuac

SEQ ID NO: 75460 - RNA, 27 nt, Artificial Sequence
  Tubulin-tyrosine ligase-like protein 12 (425-433)
agaagccuggacacccacgugacaaag

SEQ ID NO: 75461 - RNA, 33 nt, Artificial Sequence
  UHRF1-binding protein 1 (558-568)
agaagccuggagcaguucaaggccaucuacaaa

SEQ ID NO: 75462 - RNA, 27 nt, Artificial Sequence
  EWS RNA-binding protein variant 6 (391-399)
agaagccugagguacuauuacgagaag

SEQ ID NO: 75463 - RNA, 33 nt, Artificial Sequence
  Transmembrane protein 131 (709-719)
agaagccuguccgaggacgugagguucuacuau

SEQ ID NO: 75464 - RNA, 27 nt, Artificial Sequence
  Solute carrier family 25 member 35 (270-278)
agaagccuguacuauaccgacacaaag

SEQ ID NO: 75465 - RNA, 27 nt, Artificial Sequence
  Phospholipid hydroperoxide glutathione peroxidase, mitochondrial (39-47)
agaagcaugcacgaguucuccgccaag

SEQ ID NO: 75466 - RNA, 27 nt, Artificial Sequence
  Ubiquitin-like protein 7 (210-218)
agaagcaugcccuccucuucauacagg

SEQ ID NO: 75467 - RNA, 27 nt, Artificial Sequence
  Baculoviral IAP repeat-containing protein 6 (3123-3131)
agaagcaugguguccaccaucaugaag

SEQ ID NO: 75468 - RNA, 27 nt, Artificial Sequence
  Testis-specific Y-encoded protein 1 (206-214)
agaagcaaccccuacuuccagaauaag

SEQ ID NO: 75469 - RNA, 27 nt, Artificial Sequence
  Eukaryotic translation initiation factor 2 subunit 2 (285-293)
agaagccccgacaccauccugcagaag

SEQ ID NO: 75470 - RNA, 36 nt, Artificial Sequence
  Myb-binding protein 1A (545-556)
agaagccccucccugcuccagucuggcgccaagaaa

SEQ ID NO: 75471 - RNA, 30 nt, Artificial Sequence
  Histone acetyltransferase KAT2A (279-288)
agaagccaggccgaggacguggcuaccuac

SEQ ID NO: 75472 - RNA, 27 nt, Artificial Sequence
  Sorting nexin-17 (193-201)
agaagccaggaguacaagaucgugcug

SEQ ID NO: 75473 - RNA, 48 nt, Artificial Sequence
  Cold-inducible RNA-binding protein (145-160)
agaagccaguccggcggguacucugacaggucaaguggagguagcuau

SEQ ID NO: 75474 - RNA, 39 nt, Artificial Sequence
  Heterogeneous nuclear ribonucleoprotein A1-like 2 (131-143)
agaagcuccggccccuacgggggagguggccaguauuuc

SEQ ID NO: 75475 - RNA, 27 nt, Artificial Sequence
  Solute carrier family 22 member 18 (22-30)
agaagcuccgugauccugcucaccuac

SEQ ID NO: 75476 - RNA, 30 nt, Artificial Sequence
  Lysine-specific histone demethylase 1A (632-641)
agaagcaccucccagacauucaucuacaag

SEQ ID NO: 75477 - RNA, 27 nt, Artificial Sequence
  Butyrophilin subfamily 2 member A2 (135-143)
agaagcuacgacgaggccauccugagg

SEQ ID NO: 75478 - RNA, 30 nt, Artificial Sequence
  Butyrophilin subfamily 2 member A2 (135-144)
agaagcuacgacgaggccauccugaggcuc

SEQ ID NO: 75479 - RNA, 27 nt, Artificial Sequence
  Vacuolar protein sorting-associated protein 52 homolog (301-309)
agaagcuaccugggcaggcucaugaag

SEQ ID NO: 75480 - RNA, 33 nt, Artificial Sequence
  CDKN2AIP N-terminal-like protein (28-38)
agaagcuacuccgagucugaaaagcaguggaaa

SEQ ID NO: 75481 - RNA, 36 nt, Artificial Sequence
  Vimentin (28-39)
agaagcuacgugaccacauccacuaggacguauucu

SEQ ID NO: 75482 - RNA, 33 nt, Artificial Sequence
  Ribosome biogenesis protein BOP1 (9-19)
agaaccgccgcucccagcgugaggccugagaag

SEQ ID NO: 75483 - RNA, 33 nt, Artificial Sequence
  Myelin basic protein (92-102)
agaaccgcccacuacggcagccugccccagaag

SEQ ID NO: 75484 - RNA, 51 nt, Artificial Sequence
  HIRA-interacting protein 3 (190-206)
agaaccgccuggaacccccugggcgaggcugcaccuccaggggaacucuac

SEQ ID NO: 75485 - RNA, 27 nt, Artificial Sequence
  WD repeat-containing protein 91 (7-15)
agaaccgacgagcuggugagggaauac

SEQ ID NO: 75486 - RNA, 27 nt, Artificial Sequence
  Protein FAM199X (55-63)
agaaccgacccccugcacagguuccau

SEQ ID NO: 75487 - RNA, 39 nt, Artificial Sequence
  Sodium/potassium/calcium exchanger 5 (203-215)
agaaccgacagcggcaucuucuacgaggauuccggguau

SEQ ID NO: 75488 - RNA, 36 nt, Artificial Sequence
  Multivesicular body subunit 12B (107-118)
agaaccgacuacgaguaucagcacagcaaccuguac

SEQ ID NO: 75489 - RNA, 30 nt, Artificial Sequence
  Upstream stimulatory factor 1 (52-61)
agaaccgagaacggcgggcaggugauguac

SEQ ID NO: 75490 - RNA, 33 nt, Artificial Sequence
  Upstream stimulatory factor 2 (69-79)
agaaccgagacaaacggcgggcaggugacuuac

SEQ ID NO: 75491 - RNA, 36 nt, Artificial Sequence
  Plexin-C1 (1024-1035)
agaaccuucuuucccgagagcggcggguucacacac

SEQ ID NO: 75492 - RNA, 30 nt, Artificial Sequence
  Spatacsin (651-660)
agaaccuucaugaucaaguuucccuggaaa

SEQ ID NO: 75493 - RNA, 30 nt, Artificial Sequence
  Cytoplasmic dynein 1 heavy chain 1 (4159-4168)
agaaccuucagcuccauccccgugucuagg

SEQ ID NO: 75494 - RNA, 27 nt, Artificial Sequence
  Abhydrolase domain-containing protein 2 (144-152)
agaaccuucguggacuacgcccagaag

SEQ ID NO: 75495 - RNA, 27 nt, Artificial Sequence
  Probable ATP-dependent RNA helicase DDX5 (559-567)
agaaccggcaaccccacagggacuuac

SEQ ID NO: 75496 - RNA, 33 nt, Artificial Sequence
  Ras-related protein Rab-1B (48-58)
agaaccaucgagcuggacggcaagacaauuaaa

SEQ ID NO: 75497 - RNA, 42 nt, Artificial Sequence
  NADH dehydrogenase (ubiquinone) 1 beta subcomplex subunit 4 (72-85)
agaaccaucaacguguaccccaauuucaggccuacaccaaag

SEQ ID NO: 75498 - RNA, 39 nt, Artificial Sequence
  S-adenosylmethionine decarboxylase proenzyme (33-45)
agaaccauccccaggagcgagugggacauucugcucaag

SEQ ID NO: 75499 - RNA, 27 nt, Artificial Sequence
  Midasin (1582-1590)
agaacccuguucaaguuuaugaaaaag

SEQ ID NO: 75500 - RNA, 27 nt, Artificial Sequence
  DNA dC-dU-editing enzyme APOBEC-3B (183-191)
agaacccugaaggagauccucagguac

SEQ ID NO: 75501 - RNA, 33 nt, Artificial Sequence
  Disintegrin and metalloproteinase domain-containing protein 10 (147-157)
agaacccugcccuuccacagcgugaucuaccau

SEQ ID NO: 75502 - RNA, 33 nt, Artificial Sequence
  BTB/POZ domain-containing adapter for CUL3-mediated RhoA degradation protein 1 (57-67)
agaacccugacaggccaggacacuaugcucaag

SEQ ID NO: 75503 - RNA, 42 nt, Artificial Sequence
  Heat shock protein HSP 90-beta (32-45)
agaacccugacacucguggacacuggcaucgggaugacgaag

SEQ ID NO: 75504 - RNA, 36 nt, Artificial Sequence
  UDP-N-acetylhexosamine pyrophosphorylase (169-180)
agaaccauggagagcacaaaggaauucuuuacuaaa

SEQ ID NO: 75505 - RNA, 33 nt, Artificial Sequence
  Hypoxia-inducible factor 1-alpha (180-190)
agaaccaugaacaucaagagcgccacauggaaa

SEQ ID NO: 75506 - RNA, 27 nt, Artificial Sequence
  Spindle and centriole-associated protein 1 (657-665)
agaaccaacgagagccugauccagagg

SEQ ID NO: 75507 - RNA, 30 nt, Artificial Sequence
  COBW domain-containing protein 2 (353-362)
agaaccaacaggcuggugcuccuuggccgg

SEQ ID NO: 75508 - RNA, 30 nt, Artificial Sequence
  Alpha-adducin (193-202)
agaacccccagcuuccugaagaaauccaag

SEQ ID NO: 75509 - RNA, 27 nt, Artificial Sequence
  Programmed cell death 6-interacting protein (478-486)
agaacccccagcaacgagcuguacaag

SEQ ID NO: 75510 - RNA, 36 nt, Artificial Sequence
  Leucine zipper putative tumor suppressor 1 (432-443)
agaacccaggaccuggagggcgcccucaggacaaag

SEQ ID NO: 75511 - RNA, 27 nt, Artificial Sequence
  Protein disulfide-isomerase A4 (155-163)
agaacccaggaggaaaucguggccaag

SEQ ID NO: 75512 - RNA, 33 nt, Artificial Sequence
  Glycerol kinase (118-128)
agaacccagagcacaguggagucccugucuaag

SEQ ID NO: 75513 - RNA, 30 nt, Artificial Sequence
  E3 ubiquitin-protein ligase DZIP3 (287-296)
agaacccaguacaacgagcaaaucaauaag

SEQ ID NO: 75514 - RNA, 27 nt, Artificial Sequence
  SHC SH2 domain-binding protein 1 (434-442)
agaaccagcgccgaguuccugaugaag

SEQ ID NO: 75515 - RNA, 30 nt, Artificial Sequence
  Microtubule-associated protein 1B (1897-1906)
agaaccagcgacgugggcggguacuauuac

SEQ ID NO: 75516 - RNA, 27 nt, Artificial Sequence
  Phosphatidylinositol 3-kinase regulatory subunit beta (469-477)
agaaccagccaggagcugcaaaugaag

SEQ ID NO: 75517 - RNA, 33 nt, Artificial Sequence
  Plakophilin-4 (455-465)
agaaccagcucccagaggucuacacugacuuac

SEQ ID NO: 75518 - RNA, 27 nt, Artificial Sequence
  (E3-independent) E2 ubiquitin-conjugating enzyme (103-111)
agaaccacagacaucgugauuaggaua

SEQ ID NO: 75519 - RNA, 33 nt, Artificial Sequence
  Uncharacterized protein KIAA1211 (15-25)
agaaccacaagcugggccaaguccaaacuguuc

SEQ ID NO: 75520 - RNA, 27 nt, Artificial Sequence
  Eukaryotic translation initiation factor 3 subunit E (74-82)
agaaccacaguggucgcccagcugaag

SEQ ID NO: 75521 - RNA, 33 nt, Artificial Sequence
  Dolichyl-diphosphooligosaccharide-proteinosyltransferase subunit 1 (38-48)
agaaccguggaccugagcucccaccucgccaag

SEQ ID NO: 75522 - RNA, 30 nt, Artificial Sequence
  28S ribosomal protein S24, mitochondrial (77-86)
agaaccguggaggacgucuuccugaggaag

SEQ ID NO: 75523 - RNA, 33 nt, Artificial Sequence
  Serpin B6 (125-135)
agaaccguggagaaggaacugacauacgagaaa

SEQ ID NO: 75524 - RNA, 30 nt, Artificial Sequence
  Ribosome biogenesis protein BOP1 (389-398)
agaaccgugcccgucggcgggguugugaag

SEQ ID NO: 75525 - RNA, 27 nt, Artificial Sequence
  Histone-lysine N-methyltransferase SETMAR (106-114)
agaaccgugcaguggugguucaagaaa

SEQ ID NO: 75526 - RNA, 30 nt, Artificial Sequence
  Kinesin-like protein KIF22 (23-32)
agaaccgugacaggcgccaagccccugaaa

SEQ ID NO: 75527 - RNA, 27 nt, Artificial Sequence
  Ubiquitin-like-conjugating enzyme ATG3 (198-206)
agaaccuacgaccuguauaucacauac

SEQ ID NO: 75528 - RNA, 27 nt, Artificial Sequence
  Phosphatidylinositol 4-kinase alpha (889-897)
agaaccuacgacaugauccaguauuac

SEQ ID NO: 75529 - RNA, 33 nt, Artificial Sequence
  Serine-protein kinase ATM (2034-2044)
agaaccuacgagcacgaagccauguggggcaag

SEQ ID NO: 75530 - RNA, 30 nt, Artificial Sequence
  Vimentin (36-45)
agaaccuacagccugggcuccgcccucagg

SEQ ID NO: 75531 - RNA, 33 nt, Artificial Sequence
  Protein-methionine sulfoxide oxidase MICAL3 (192-202)
agaaccuacacagaggaagagcugaacgccaag

SEQ ID NO: 75532 - RNA, 30 nt, Artificial Sequence
  Nucleolar and coiled-body phosphoprotein 1 (638-647)
agaguggccgacaacagcuucgaugcuaag

SEQ ID NO: 75533 - RNA, 27 nt, Artificial Sequence
  Arginine vasopressin-induced protein 1 (66-74)
agaguggccgaggcucugaagaggcuc

SEQ ID NO: 75534 - RNA, 27 nt, Artificial Sequence
  Chondroitin sulfate synthase 3 (30-38)
agaguggccgagcugagcgaaaggaag

SEQ ID NO: 75535 - RNA, 27 nt, Artificial Sequence
  Caspase-9 (236-244)
agaguggccaacgcugucagcguuaag

SEQ ID NO: 75536 - RNA, 39 nt, Artificial Sequence
  Caspase-9 (236-248)
agaguggccaacgcugucagcguuaagggcaucuacaaa

SEQ ID NO: 75537 - RNA, 33 nt, Artificial Sequence
  7-dehydrocholesterol reductase (339-349)
agaguggccaaccaccagaaggaccuguucagg

SEQ ID NO: 75538 - RNA, 33 nt, Artificial Sequence
  SHC-transforming protein 3 (55-65)
agagugugcgaggccguccccggcgcuaagggg

SEQ ID NO: 75539 - RNA, 30 nt, Artificial Sequence
  Transmembrane protein 98 (138-147)
agaguggacgaugucguuaagagcauguac

SEQ ID NO: 75540 - RNA, 30 nt, Artificial Sequence
  Protein OS-9 (16-25)
agaguggacgagccccugagcugcuccuac

SEQ ID NO: 75541 - RNA, 27 nt, Artificial Sequence
  Eukaryotic peptide chain release factor subunit 1 (402-410)
agaguggacuuccagggcauggaguac

SEQ ID NO: 75542 - RNA, 33 nt, Artificial Sequence
  Nuclear fragile X mental retardation-interacting protein 2 (272-282)
agaguggacggcagcaagcccaucuggaaauac

SEQ ID NO: 75543 - RNA, 30 nt, Artificial Sequence
  COP9 signalosome complex subunit 1 (484-493)
agaguggacagccacuccaagauccuguac

SEQ ID NO: 75544 - RNA, 30 nt, Artificial Sequence
  Brefeldin A-inhibited guanine nucleotide-exchange protein 1 (1662-1671)
agaguggacacccaggaucaaggcauguac

SEQ ID NO: 75545 - RNA, 27 nt, Artificial Sequence
  Coiled-coil domain-containing protein 127 (252-260)
agaguggaggaagccauccuggagaag

SEQ ID NO: 75546 - RNA, 33 nt, Artificial Sequence
  Copine-1 (267-277)
agaguggagaccgaauacagcuuccuggacuau

SEQ ID NO: 75547 - RNA, 30 nt, Artificial Sequence
  Tumor protein D53 (48-57)
agaguggagaccacagucacuagccugaag

SEQ ID NO: 75548 - RNA, 30 nt, Artificial Sequence
  Chromobox protein homolog 6 (9-18)
agaguguucgccgcugagagcaucauuaag

SEQ ID NO: 75549 - RNA, 27 nt, Artificial Sequence
  Eukaryotic initiation factor 4A-III (166-174)
agaguguucgacaugaucaggcggcgc

SEQ ID NO: 75550 - RNA, 30 nt, Artificial Sequence
  DNA topoisomerase 3-beta-1 (263-272)
agaguguucgacagggagaucgcccagaug

SEQ ID NO: 75551 - RNA, 27 nt, Artificial Sequence
  Annexin A1 (235-243)
agaguguuccagaaguacaccaaauau

SEQ ID NO: 75552 - RNA, 30 nt, Artificial Sequence
  Hermansky-Pudlak syndrome 5 protein (137-146)
agaguguucgucggcgaccacgccgggaag

SEQ ID NO: 75553 - RNA, 36 nt, Artificial Sequence
  Non-specific lipid-transfer protein (13-24)
agaguguucgucguuggcguggggaugaccaaguuu

SEQ ID NO: 75554 - RNA, 27 nt, Artificial Sequence
  Receptor activity-modifying protein 2 (18-26)
agagugggcaggcccgccgcucugcgg

SEQ ID NO: 75555 - RNA, 36 nt, Artificial Sequence
  ATP-dependent RNA helicase DDX3X (407-418)
agagugggcagcaccuccgagaacaucacacagaag

SEQ ID NO: 75556 - RNA, 27 nt, Artificial Sequence
  Dol-P-Man:Man(5)GlcNAc(2)-PP-Dol alpha-1,3-mannosyltransferase (115-123)
agagugcacagcaucuucguccugagg

SEQ ID NO: 75557 - RNA, 30 nt, Artificial Sequence
  Lon protease homolog 2, peroxisomal (197-206)
agagugaucgccauuaggcccauacggcgc

SEQ ID NO: 75558 - RNA, 27 nt, Artificial Sequence
  B-cell lymphoma 3 protein (267-275)
agagugaucgacauucugaggggcaag

SEQ ID NO: 75559 - RNA, 36 nt, Artificial Sequence
  Serine/threonine-protein kinase TBK1 (143-154)
agagugaucggcgaggacgggcagagcgucuacaag

SEQ ID NO: 75560 - RNA, 39 nt, Artificial Sequence
  Stress-70 protein, mitochondrial (218-230)
agagugaucaacgagcccaccgccgcugcacuggccuac

SEQ ID NO: 75561 - RNA, 33 nt, Artificial Sequence
  Synembryn-A (493-503)
agagugauccagcccaugggcaugagcccuagg

SEQ ID NO: 75562 - RNA, 33 nt, Artificial Sequence
  GDP-fucose protein O-fucosyltransferase 1 (101-111)
agagugaucagccuggaggacuucauggaaaag

SEQ ID NO: 75563 - RNA, 36 nt, Artificial Sequence
  Creatine kinase M-type (236-247)
agagugaucagcauggagaagggcgggaacaugaaa

SEQ ID NO: 75564 - RNA, 36 nt, Artificial Sequence
  COX assembly mitochondrial protein 2 homolog (63-74)
agagugaucgucacccacggcagccugaagcucaaa

SEQ ID NO: 75565 - RNA, 27 nt, Artificial Sequence
  ENTH domain-containing protein 1 (376-384)
agagugaaggagaucgucauuaacaaa

SEQ ID NO: 75566 - RNA, 36 nt, Artificial Sequence
  Epidermal growth factor receptor substrate 15 (33-44)
agagugcuggccagcgacgcugcagccuuccucaag

SEQ ID NO: 75567 - RNA, 30 nt, Artificial Sequence
  Transient receptor potential cation channel subfamily M member 1 (871-880)
agagugcuggacaucuucggcgucaacaag

SEQ ID NO: 75568 - RNA, 33 nt, Artificial Sequence
  Anaphase-promoting complex subunit 2 (163-173)
agagugcuggaccccagcauggucauccucgag

SEQ ID NO: 75569 - RNA, 36 nt, Artificial Sequence
  Monofunctional C1-tetrahydrofolate synthase, mitochondrial (497-508)
agagugcuggacaccaacgauagguuccuccggaag

SEQ ID NO: 75570 - RNA, 30 nt, Artificial Sequence
  Uncharacterized protein C19orf52 (162-171)
agagugcuggacgucggcuucguugggagg

SEQ ID NO: 75571 - RNA, 27 nt, Artificial Sequence
  Paired amphipathic helix protein Sin3b (506-514)
agagugcuggagagcguccagaagaaa

SEQ ID NO: 75572 - RNA, 33 nt, Artificial Sequence
  Nipped-B-like protein (1779-1789)
agagugcugggcgagaacgccaucgcugucagg

SEQ ID NO: 75573 - RNA, 27 nt, Artificial Sequence
  Interferon-stimulated gene 20 kDa protein (131-139)
agagugcugagcgagaggcuccuucac

SEQ ID NO: 75574 - RNA, 30 nt, Artificial Sequence
  Interferon-stimulated gene 20 kDa protein (131-140)
agagugcugagcgagaggcuccuucacaag

SEQ ID NO: 75575 - RNA, 27 nt, Artificial Sequence
  14-3-3 protein sigma (60-68)
agagugcugagcuccaucgagcagaag

SEQ ID NO: 75576 - RNA, 33 nt, Artificial Sequence
  Guanine nucleotide-binding protein G(s) subunit alpha isoforms short (187-197)
agagugcugaccagcggcaucuucgagacaaag

SEQ ID NO: 75577 - RNA, 27 nt, Artificial Sequence
  T lymphocyte c-maf long form (21-29)
agagugcugaccagcgucuucacaaag

SEQ ID NO: 75578 - RNA, 27 nt, Artificial Sequence
  Beta-parvin (351-359)
agagugcuguacaaccucuucaccaag

SEQ ID NO: 75579 - RNA, 33 nt, Artificial Sequence
  B-cell CLL/lymphoma 7 protein family member A (20-30)
agagugauggccgcuaucgagaaggucaggaaa

SEQ ID NO: 75580 - RNA, 33 nt, Artificial Sequence
  Nuclear transcription factor Y subunit gamma (25-35)
agagugauggaggaaaucaggaaccugaccguc

SEQ ID NO: 75581 - RNA, 33 nt, Artificial Sequence
  Poly (ADP-ribose) polymerase 4 (419-429)
agagugaacgagaccacagaauuccugagcaag

SEQ ID NO: 75582 - RNA, 30 nt, Artificial Sequence
  Ceramide synthase 5 (379-388)
agagugaacggccacauggggggaagcuac

SEQ ID NO: 75583 - RNA, 27 nt, Artificial Sequence
  Cytoplasmic dynein 1 heavy chain 1 (759-767)
agagugccccuggccaucgucaacaag

SEQ ID NO: 75584 - RNA, 30 nt, Artificial Sequence
  Protein scribble homolog (161-170)
agagugccccaggccgagggcccuccaaag

SEQ ID NO: 75585 - RNA, 33 nt, Artificial Sequence
  Phosphatidylinositol 3-kinase regulatory subunit gamma (209-219)
agagugcaggccgaggaccugcucuacggcaag

SEQ ID NO: 75586 - RNA, 30 nt, Artificial Sequence
  Large neutral amino acids transporter small subunit 1 (195-204)
agagugcaggacgccuucgcugcagccaag

SEQ ID NO: 75587 - RNA, 36 nt, Artificial Sequence
  ATPase family AAA domain-containing protein 3A (605-616)
agagugcaggacgccguccaacagcaccagcagaag

SEQ ID NO: 75588 - RNA, 33 nt, Artificial Sequence
  Fibronectin type III domain-containing protein 3B (271-281)
agagugcaggacauccugagcggcauugagaag

SEQ ID NO: 75589 - RNA, 27 nt, Artificial Sequence
  6-phosphofructo-2-kinase/fructose-2,6-bisphosphatase 2 (228-236)
agagugcaggacuacauccaaagcaag

SEQ ID NO: 75590 - RNA, 33 nt, Artificial Sequence
  Probable ATP-dependent RNA helicase DHX37 (767-777)
agagugcagagcgaggaaaugcuggaggacaag

SEQ ID NO: 75591 - RNA, 30 nt, Artificial Sequence
  Charged multivesicular body protein 1b (75-84)
agagugcagaccgccgucacaaugggcaag

SEQ ID NO: 75592 - RNA, 42 nt, Artificial Sequence
  28S ribosomal protein S29, mitochondrial (232-245)
agagugaggaacgccaccgacgcugucggcaucguucugaag

SEQ ID NO: 75593 - RNA, 27 nt, Artificial Sequence
  F-box only protein 21 (77-85)
agagugagguggcccagccugaugaag

SEQ ID NO: 75594 - RNA, 30 nt, Artificial Sequence
  Platelet-activating factor acetylhydrolase 2, cytoplasmic (188-197)
agagugagcgagugccugaggguccucaag

SEQ ID NO: 75595 - RNA, 27 nt, Artificial Sequence
  ADP-ribosylation factor GTPase-activating protein 1 (148-156)
agagugagcggccagccccaauccguc

SEQ ID NO: 75596 - RNA, 27 nt, Artificial Sequence
  DNA polymerase delta catalytic subunit (537-545)
agagugaccggcgucccccugagcuac

SEQ ID NO: 75597 - RNA, 30 nt, Artificial Sequence
  E3 ubiquitin-protein ligase MIB2 (258-267)
agaguggucgacaucaggggcugggauguu

SEQ ID NO: 75598 - RNA, 27 nt, Artificial Sequence
  NADH dehydrogenase (ubiquinone) 1 alpha subcomplex subunit 6 (77-85)
agaguggucgaccugcucguuaucaag

SEQ ID NO: 75599 - RNA, 33 nt, Artificial Sequence
  Lysine-specific histone demethylase 1B (420-430)
agagugugggacgauaagagcuucaaaggcguc

SEQ ID NO: 75600 - RNA, 33 nt, Artificial Sequence
  Coatomer subunit alpha (160-170)
agagugugggacaucagcggccugaggaagaaa

SEQ ID NO: 75601 - RNA, 39 nt, Artificial Sequence
  ATP-binding cassette sub-family B member 8, mitochondrial (669-681)
agagugugggaggccggcacccacgaagagcugcucaag

SEQ ID NO: 75602 - RNA, 30 nt, Artificial Sequence
  Methyltransferase-like protein 8 (334-343)
agaguguggauccagggcaaguuccaaaaa

SEQ ID NO: 75603 - RNA, 30 nt, Artificial Sequence
  Charged multivesicular body protein 1a (46-55)
agaguguacgccgagaacgcuaucaggaag

SEQ ID NO: 75604 - RNA, 27 nt, Artificial Sequence
  Neuferricin (62-70)
agaguguacgacgucagcuccggcagg

SEQ ID NO: 75605 - RNA, 27 nt, Artificial Sequence
  Formin-binding protein 1-like (96-104)
agaguguacggcgagcugaugagguau

SEQ ID NO: 75606 - RNA, 30 nt, Artificial Sequence
  Actin filament-associated protein 1-like 2 (535-544)
agaguguaccuggaccucacccccgucaag

SEQ ID NO: 75607 - RNA, 33 nt, Artificial Sequence
  Transcription termination factor 2 (414-424)
agaguguaccugaccacacagcucaagcaaaaa

SEQ ID NO: 75608 - RNA, 27 nt, Artificial Sequence
  Follistatin-related protein 5 (344-352)
agaguguaccccgagagccaggccagg

SEQ ID NO: 75609 - RNA, 33 nt, Artificial Sequence
  Serine/threonine-protein kinase pim-1 (296-306)
agaguguacagccccccugaguggaucagguau

SEQ ID NO: 75610 - RNA, 30 nt, Artificial Sequence
  Epidermal growth factor receptor kinase substrate 8 (772-781)
agaguguacagccagaucaccguccaaaag

SEQ ID NO: 75611 - RNA, 33 nt, Artificial Sequence
  Bifunctional 3'-phosphoadenosine 5'-phosphosulfate synthase 1 (386-396)
agaguguacuggaacgacggccuggaucaguau

SEQ ID NO: 75612 - RNA, 27 nt, Artificial Sequence
  ATP-binding cassette sub-family B member 6, mitochondrial (144-152)
agauacagggaggccaucauuaaguau

SEQ ID NO: 75613 - RNA, 27 nt, Artificial Sequence
  Melanoma inhibitory activity protein 3 (1397-1405)
agcgccgcugaggaagugaagaccuac

SEQ ID NO: 75614 - RNA, 27 nt, Artificial Sequence
  Transketolase (43-51)
agcgccgcugagaucauggcagugcug

SEQ ID NO: 75615 - RNA, 27 nt, Artificial Sequence
  Kinesin-like protein KIFC3 (471-479)
agcgccgcugagaucuacaacgaagug

SEQ ID NO: 75616 - RNA, 27 nt, Artificial Sequence
  Protein fem-1 homolog C (91-99)
agcgccgcuggccaccugaaggugguc

SEQ ID NO: 75617 - RNA, 27 nt, Artificial Sequence
  E3 ubiquitin-protein ligase AMFR (606-614)
agcgccgacgagagacagaggaugcug

SEQ ID NO: 75618 - RNA, 33 nt, Artificial Sequence
  Laminin subunit beta-3 (706-716)
agcgccgaccccuccggcgcuuucagaaugcug

SEQ ID NO: 75619 - RNA, 27 nt, Artificial Sequence
  GRIP and coiled-coil domain-containing protein 2 (1284-1292)
agcgccgagcagcaccaaagaacccug

SEQ ID NO: 75620 - RNA, 27 nt, Artificial Sequence
  Mortality factor 4-like protein 2 (280-288)
agcgccgaguaccacagaaaggcucug

SEQ ID NO: 75621 - RNA, 33 nt, Artificial Sequence
  Coiled-coil domain-containing protein 77 (190-200)
agcgccuucaaggcugaccccaaaaucuccaag

SEQ ID NO: 75622 - RNA, 33 nt, Artificial Sequence
  Versican core protein (1221-1231)
agcgccuucaagcccuccucugcuaucaccaaa

SEQ ID NO: 75623 - RNA, 30 nt, Artificial Sequence
  Zinc finger protein 703 (400-409)
agcgcccacgaccccgcuggcccuucccug

SEQ ID NO: 75624 - RNA, 27 nt, Artificial Sequence
  Transcription factor 20 (608-616)
agcgcccacgagcccggcgggucccug

SEQ ID NO: 75625 - RNA, 36 nt, Artificial Sequence
  Probable cation-transporting ATPase 13A3 (802-813)
agcgccaucgaccccgaggcuauuccugugaagcug

SEQ ID NO: 75626 - RNA, 27 nt, Artificial Sequence
  Protein AATF (141-149)
agcgccaagacccccggcuucuccgug

SEQ ID NO: 75627 - RNA, 30 nt, Artificial Sequence
  Ras-specific guanine nucleotide-releasing factor 1 (254-263)
agcgcccuggagaucgcugaacagcucacc

SEQ ID NO: 75628 - RNA, 36 nt, Artificial Sequence
  Fc receptor-like A (117-128)
agcgcccugggccccccugggccaaacagagaguuc

SEQ ID NO: 75629 - RNA, 33 nt, Artificial Sequence
  Vimentin (42-52)
agcgcccugagacccuccaccucuaggucacuc

SEQ ID NO: 75630 - RNA, 39 nt, Artificial Sequence
  Vimentin (42-54)
agcgcccugagacccuccaccucuaggucacucuacgcu

SEQ ID NO: 75631 - RNA, 33 nt, Artificial Sequence
  Actin-related protein 2/3 complex subunit 1A (298-308)
agcgccauggagagauucaggaacauggacaag

SEQ ID NO: 75632 - RNA, 27 nt, Artificial Sequence
  Fatty acid synthase (2039-2047)
agcgccauggagagaaucugcgaaaag

SEQ ID NO: 75633 - RNA, 30 nt, Artificial Sequence
  Cytoplasmic dynein 1 heavy chain 1 (1505-1514)
agcgccaugaagcugucccccuacuauaaa

SEQ ID NO: 75634 - RNA, 30 nt, Artificial Sequence
  Syntenin-1 (23-32)
agcgccaaccccgcuaauccugcaauccug

SEQ ID NO: 75635 - RNA, 30 nt, Artificial Sequence
  Vacuole membrane protein 1 isoform 8 (83-92)
agcgcccaggacuucgcuuccagagcaaag

SEQ ID NO: 75636 - RNA, 30 nt, Artificial Sequence
  HLA class I histocompatibility antigen, alpha chain E (339-348)
agcgcccagggcuccgagucucacucacug

SEQ ID NO: 75637 - RNA, 27 nt, Artificial Sequence
  ATP-dependent RNA helicase DDX54 (145-153)
agcgcccagaccggcgcuagagcacug

SEQ ID NO: 75638 - RNA, 27 nt, Artificial Sequence
  Poly(rC)-binding protein 2 (254-262)
agcgcccagaccacaucccacgagcug

SEQ ID NO: 75639 - RNA, 27 nt, Artificial Sequence
  ADP-dependent glucokinase (213-221)
agcgccuccggcccccacucuucacug

SEQ ID NO: 75640 - RNA, 30 nt, Artificial Sequence
  Nodal modulator 3 (166-175)
agcgccguggaguucagacagaccggcuac

SEQ ID NO: 75641 - RNA, 30 nt, Artificial Sequence
  Histone acetyltransferase type B catalytic subunit (16-25)
agcgccguggagaagaaacuggcugaauac

SEQ ID NO: 75642 - RNA, 27 nt, Artificial Sequence
  ADP-ribosylation factor-binding protein GGA1 (288-296)
agcgccgugcccaaggucaugaaaguu

SEQ ID NO: 75643 - RNA, 27 nt, Artificial Sequence
  Ankyrin repeat domain-containing protein 20B (272-280)
agcgccguguccaucuuccacgagcug

SEQ ID NO: 75644 - RNA, 27 nt, Artificial Sequence
  Long-chain-fatty-acid-CoA ligase 3 (66-74)
agcgccuacagauccgugaacucucug

SEQ ID NO: 75645 - RNA, 33 nt, Artificial Sequence
  Ribulose-phosphate 3-epimerase (186-196)
agcgaggaccccagauccgugaucaaccugcuc

SEQ ID NO: 75646 - RNA, 30 nt, Artificial Sequence
  WD repeat and FYVE domain-containing protein 1 (43-52)
agcgaggacagaaccaucaggguguggcug

SEQ ID NO: 75647 - RNA, 30 nt, Artificial Sequence
  Clathrin heavy chain 1 (825-834)
agcgaggacgugaucaagaaccugauucuc

SEQ ID NO: 75648 - RNA, 30 nt, Artificial Sequence
  Microtubule-associated protein 4 (230-239)
agcgaggaaagacccccugcccaggcucug

SEQ ID NO: 75649 - RNA, 30 nt, Artificial Sequence
  Cortactin-binding protein 2 (232-241)
agcgaguucgacaccgaaagagagcagcug

SEQ ID NO: 75650 - RNA, 27 nt, Artificial Sequence
  Ubiquitin carboxyl-terminal hydrolase 48 (254-262)
agcgaguuccugaaggaagagaaacuc

SEQ ID NO: 75651 - RNA, 39 nt, Artificial Sequence
  55 kDa erythrocyte membrane protein (6-18)
agcgagggcgaauccgggggaucuaugcacaccgcccug

SEQ ID NO: 75652 - RNA, 27 nt, Artificial Sequence
  Copper transport protein ATOX1 (44-52)
agcgagcacuccauggacacccugcuc

SEQ ID NO: 75653 - RNA, 39 nt, Artificial Sequence
  Ventricular zone-expressed PH domain-containing protein homolog 1 (106-118)
agcgagaucgacccccugggccaggggaacgauaagcuc

SEQ ID NO: 75654 - RNA, 27 nt, Artificial Sequence
  Prolyl 3-hydroxylase OGFOD1 (290-298)
agcgagauccugcucaaggaauuccuu

SEQ ID NO: 75655 - RNA, 27 nt, Artificial Sequence
  Nucleolar protein 10 (225-233)
agcgagaucaacucccugcccaccauu

SEQ ID NO: 75656 - RNA, 33 nt, Artificial Sequence; identical to SEQ ID NO: 51429
  Leucine-rich repeat LGI family member 3 (77-87)

SEQ ID NO: 75657 - RNA, 27 nt, Artificial Sequence
  Serine-protein kinase ATM (707-715)
agcgagaucaccaacuccgaaacacug

SEQ ID NO: 75658 - RNA, 30 nt, Artificial Sequence
  Nuclear pore complex protein Nup50 (255-264)
agcgagaagaaaaccgaccccuccucucug

SEQ ID NO: 75659 - RNA, 24 nt, Artificial Sequence
  Talin-1 (1958-1965)
agcgagaaggugucccacguccug

SEQ ID NO: 75660 - RNA, 30 nt, Artificial Sequence
  Protein strawberry notch homolog 1 (911-920)
agcgagcuggacgugcccgucgaaauccuc

SEQ ID NO: 75661 - RNA, 33 nt, Artificial Sequence
  Protein S100-B (31-41)
agcgagcugaaggaacucaucaacaaugagcuu

SEQ ID NO: 75662 - RNA, 33 nt, Artificial Sequence
  U2 snRNP-associated SURP motif-containing protein (401-411)
agcgagauguccgaagagaagagagccaaacug

SEQ ID NO: 75663 - RNA, 27 nt, Artificial Sequence
  Protein piccolo (3378-3386)
agcgagaacucccagcaccuggaacuc

SEQ ID NO: 75664 - RNA, 30 nt, Artificial Sequence; identical to SEQ ID NO: 51437
  Mitotic checkpoint serine/threonine-protein kinase BUB1 (159-168)

SEQ ID NO: 75665 - RNA, 33 nt, Artificial Sequence
  Gap junction beta-1 protein (253-263)
agcgagcaggacggcucccugaaggauauccuc

SEQ ID NO: 75666 - RNA, 36 nt, Artificial Sequence
  Transformation/transcription domain-associated protein (434-445)
agcgagcaggaauccggcaacgggagagacgugcug

SEQ ID NO: 75667 - RNA, 27 nt, Artificial Sequence
  Multidrug resistance-associated protein 4 (13-21)
agcgagacccccacacugcagggccuc

SEQ ID NO: 75668 - RNA, 36 nt, Artificial Sequence
  Vitamin K epoxide reductase complex subunit 1 (44-55)
agcuucagaaaggugcaggagccccaaggcaaagcc

SEQ ID NO: 75669 - RNA, 27 nt, Artificial Sequence
  POTE ankyrin domain family member F (855-863)
agcggcgacggggugacccacacaguc

SEQ ID NO: 75670 - RNA, 27 nt, Artificial Sequence
  Disabled homolog 2 (538-546)
agcggcuucucccagcccgugaucuuu

SEQ ID NO: 75671 - RNA, 42 nt, Artificial Sequence
  Heterogeneous nuclear ribonucleoprotein U-like protein 1 (662-675)
agcggcgggggagguuacucccagaacagauggggcaauaac

SEQ ID NO: 75672 - RNA, 45 nt, Artificial Sequence
  Prelamin-A/C (483-497)
agcggcgggggauccuucggugacaaccuggugaccagaucuuac

SEQ ID NO: 75673 - RNA, 42 nt, Artificial Sequence
  Keratin, type II cytoskeletal 1 (604-617)
agcggcgggggauccucugguggcucaaucgggggaagaggc

SEQ ID NO: 75674 - RNA, 39 nt, Artificial Sequence
  Cold-inducible RNA-binding protein (148-160)
agcggcggguacuccgacagaucuucaggagguaguuau

SEQ ID NO: 75675 - RNA, 45 nt, Artificial Sequence
  Serine/threonine-protein phosphatase PP1-beta catalytic subunit (311-325)
agcggcagacccgugaccccuccaaggacagccaacccgcccaag

SEQ ID NO: 75676 - RNA, 30 nt, Artificial Sequence
  Frataxin, mitochondrial (81-90)
agcggcacccuggggcaccccggaucccuc

SEQ ID NO: 75677 - RNA, 39 nt, Artificial Sequence
  Caprin-1 (663-675)
agcggcuaccagagagacggguaucaacagaacuucaag

SEQ ID NO: 75678 - RNA, 27 nt, Artificial Sequence
  Protein kinase C delta-binding protein (70-78)
agccacgacaccacauccaacacucug

SEQ ID NO: 75679 - RNA, 30 nt, Artificial Sequence
  E3 ubiquitin-protein ligase TRIM32 (566-575)
agccacuucuuuuccgagaacgaagacuuc

SEQ ID NO: 75680 - RNA, 30 nt, Artificial Sequence
  ATP-dependent RNA helicase DDX42 (307-316)
agccacgugagacccgacaggcagacccug

SEQ ID NO: 75681 - RNA, 27 nt, Artificial Sequence
  Transmembrane protein 147 (87-95)
agcaucgacuccaacauuucucuggug

SEQ ID NO: 75682 - RNA, 27 nt, Artificial Sequence
  Neuron navigator 2 (1236-1244)
agcaucgacuccaacauuucuucaaag

SEQ ID NO: 75683 - RNA, 36 nt, Artificial Sequence
  Fructose-bisphosphate aldolase A (46-57)
agcaucggcaccgagaacacagaagagaauagaagg

SEQ ID NO: 75684 - RNA, 27 nt, Artificial Sequence
  Septin-9 (321-329)
agcauccacuucgaggccuacagagug

SEQ ID NO: 75685 - RNA, 30 nt, Artificial Sequence
  Lanosterol 14-alpha demethylase (173-182)
agcaucauugagaaggaaaccaaagaguac

SEQ ID NO: 75686 - RNA, 27 nt, Artificial Sequence
  Heterogeneous nuclear ribonucleoprotein K (401-409)
agcaucauuggcaaggggggacagaga

SEQ ID NO: 75687 - RNA, 33 nt, Artificial Sequence
  Interleukin-1 receptor accessory protein (317-327)
agcaucaagaaagugaccuccgaggaccugaag

SEQ ID NO: 75688 - RNA, 33 nt, Artificial Sequence
  Ubiquitin carboxyl-terminal hydrolase 11 (519-529)
agcauccuggacagagaugacauuuucguguac

SEQ ID NO: 75689 - RNA, 33 nt, Artificial Sequence
  Mortality factor 4-like protein 1 (192-202)
agcauccuggaggacuacgccaacuauaagaaa

SEQ ID NO: 75690 - RNA, 39 nt, Artificial Sequence
  Protein transport protein Sec31A (332-344)
agcaucaugggcggguccaccgacggacugagacagaag

SEQ ID NO: 75691 - RNA, 27 nt, Artificial Sequence
  Casein kinase I isoform delta (401-409)
agcauccccuucgagcaccauggcaag

SEQ ID NO: 75692 - RNA, 30 nt, Artificial Sequence
  Protein maestro (14-23)
agcauccccaccucccagccuaagcaaaaa

SEQ ID NO: 75693 - RNA, 30 nt, Artificial Sequence
  Inosine-5'-monophosphate dehydrogenase 1 (531-540)
agcauccaggacaagggcuccauucaaaaa

SEQ ID NO: 75694 - RNA, 30 nt, Artificial Sequence
  NHP2-like protein 1 (118-127)
agcauccagcaauccauugagagacugcuc

SEQ ID NO: 75695 - RNA, 39 nt, Artificial Sequence
  ATP synthase F(0) complex subunit B1, mitochondrial (226-238)
agcaucuccacccagcaagagaaggaaacaauugccaaa

SEQ ID NO: 75696 - RNA, 36 nt, Artificial Sequence
  StAR-related lipid transfer protein 13 (339-350)
agcaucuacgacaacgugcccggcucccaccuguau

SEQ ID NO: 75697 - RNA, 36 nt, Artificial Sequence
  Carboxypeptidase Q (211-222)
agcaucuacuccccccacaccggcauucaggaguau

SEQ ID NO: 75698 - RNA, 39 nt, Artificial Sequence
  Keratin, type I cytoskeletal 10 (148-160)
agcaaggagcugaccacagaaaucgacaacaauauugag

SEQ ID NO: 75699 - RNA, 27 nt, Artificial Sequence
  Receptor-interacting serine/threonine-protein kinase 1 (376-384)
agcaagcugcaggacgaggccaacuac

SEQ ID NO: 75700 - RNA, 39 nt, Artificial Sequence
  CDK5 regulatory subunit-associated protein 2 (133-145)
agccuggccgaggcuggcggguccgaaauccagagagug

SEQ ID NO: 75701 - RNA, 27 nt, Artificial Sequence
  MICAL-like protein 2 (22-30)
agccuggccgaguucucccuccuuaag

SEQ ID NO: 75702 - RNA, 33 nt, Artificial Sequence
  Wiskott-Aldrich syndrome protein family member 2 (67-77)
agccuggccgagagaguggacaggcuccagguc

SEQ ID NO: 75703 - RNA, 24 nt, Artificial Sequence
  Nucleolar protein 11 (286-293)
agccugugccccgaccucauggag

SEQ ID NO: 75704 - RNA, 27 nt, Artificial Sequence
  Insulin-degrading enzyme (224-232)
agccuggacgaucucaccaaccuugug

SEQ ID NO: 75705 - RNA, 27 nt, Artificial Sequence
  Signal peptidase complex subunit 2 (59-67)
agccuggacgauuccgccaagaaagug

SEQ ID NO: 75706 - RNA, 33 nt, Artificial Sequence
  Signal peptidase complex subunit 2 (59-69)
agccuggacgauuccgccaagaaagugcuccuu

SEQ ID NO: 75707 - RNA, 27 nt, Artificial Sequence
  Sodium/potassium-transporting ATPase subunit alpha-1 (47-55)
agccuggacgagcuccacagaaaguac

SEQ ID NO: 75708 - RNA, 27 nt, Artificial Sequence
  Transmembrane protein 132B (241-249)
agccuggacgagaugguggucuccguu

SEQ ID NO: 75709 - RNA, 27 nt, Artificial Sequence
  GREB1-like protein (74-82)
agccuggacuucuccaacaaucucacc

SEQ ID NO: 75710 - RNA, 27 nt, Artificial Sequence
  2'-5'-oligoadenylate synthase 2 (123-131)
agccuggacggcuucaccauccaggug

SEQ ID NO: 75711 - RNA, 27 nt, Artificial Sequence
  Angio-associated migratory cell protein (93-101)
agccuggaccccaagaccaacacacuc

SEQ ID NO: 75712 - RNA, 21 nt, Artificial Sequence
  Eukaryotic translation initiation factor 3 subunit C-like protein (835-841)
agccuggaccagcccacccaa

SEQ ID NO: 75713 - RNA, 27 nt, Artificial Sequence
  Regulator of nonsense transcripts 2 (992-1000)
agccuggaggaauccaucagacaggug

SEQ ID NO: 75714 - RNA, 36 nt, Artificial Sequence
  Heterogeneous nuclear ribonucleoprotein M (536-547)
agccuggagagaaugggccucgaaaggaugggggcc

SEQ ID NO: 75715 - RNA, 39 nt, Artificial Sequence
  Heterogeneous nuclear ribonucleoprotein M (536-548)
agccuggagagaaugggccucgaaaggaugggggccaac

SEQ ID NO: 75716 - RNA, 27 nt, Artificial Sequence
  ATP-sensitive inward rectifier potassium channel 10 (186-194)
agccuguucgaccagguggucaagguu

SEQ ID NO: 75717 - RNA, 36 nt, Artificial Sequence
  Inositol 1,4,5-trisphosphate receptor type 3 (365-376)
agccuguucgagcucgaccccaccacacuucagaag

SEQ ID NO: 75718 - RNA, 30 nt, Artificial Sequence
  Utrophin (249-258)
agccuguucgaggugcucccccagcaaguc

SEQ ID NO: 75719 - RNA, 27 nt, Artificial Sequence
  Microtubule-associated tumor suppressor 1 (694-702)
agccuguuccucggcuccgccucuaag

SEQ ID NO: 75720 - RNA, 27 nt, Artificial Sequence
  V-type proton ATPase 116 kDa subunit a isoform 1 (555-563)
agccuguucaaccacaucuacuuuaag

SEQ ID NO: 75721 - RNA, 27 nt, Artificial Sequence
  Ventricular zone-expressed PH domain-containing protein homolog 1 (252-260)
agccuguuccccgagccucucuccauc

SEQ ID NO: 75722 - RNA, 30 nt, Artificial Sequence
  Eukaryotic translation initiation factor 3 subunit E (218-227)
agccuguucguguuuuucaaccaccccaag

SEQ ID NO: 75723 - RNA, 27 nt, Artificial Sequence
  Metalloproteinase inhibitor 3 (15-23)
agccugggcgacuggggggccgaggcu

SEQ ID NO: 75724 - RNA, 27 nt, Artificial Sequence
  Ran GTPase-activating protein 1 (102-110)
agccugggcgaggggcucaucaccgcc

SEQ ID NO: 75725 - RNA, 30 nt, Artificial Sequence
  Homeobox protein SEBOX (201-210)
agccugggcucccucucugaccuuaucuac

SEQ ID NO: 75726 - RNA, 27 nt, Artificial Sequence
  Nuclear receptor subfamily 4 group A member 1 (492-500)
agccugcacucccuccuuguggacguc

SEQ ID NO: 75727 - RNA, 27 nt, Artificial Sequence
  Carboxypeptidase M (303-311)
agccugaucgaguacauuaagcaggug

SEQ ID NO: 75728 - RNA, 30 nt, Artificial Sequence
  Zinc finger FYVE domain-containing protein 16 (160-169)
agccugaucggccucgaccuuuccucugug

SEQ ID NO: 75729 - RNA, 27 nt, Artificial Sequence
  Src kinase-associated phosphoprotein 2 (47-55)
agccugaucaagaaaauuaaggacgug

SEQ ID NO: 75730 - RNA, 27 nt, Artificial Sequence
  Small glutamine-rich tetratricopeptide repeat-containing protein beta (33-41)
agccugaucaacaaucccgccuucauu

SEQ ID NO: 75731 - RNA, 27 nt, Artificial Sequence
  Anoctamin-4 (154-162)
agccugaucaacuccgacauuauauuc

SEQ ID NO: 75732 - RNA, 30 nt, Artificial Sequence
  Anoctamin-4 (154-163)
agccugaucaacuccgacauuauauucgug

SEQ ID NO: 75733 - RNA, 33 nt, Artificial Sequence
  Serine/threonine-protein kinase Sgk1 (451-461)
agccugaucaacugggacgaucucauuaauaag

SEQ ID NO: 75734 - RNA, 33 nt, Artificial Sequence
  Probable global transcription activator SNF2L1 (137-147)
agccugaucuccgccggcgacuacagacacagg

SEQ ID NO: 75735 - RNA, 27 nt, Artificial Sequence
  Lambda-crystallin homolog (73-81)
agccugaucuccggcugccccaacauu

SEQ ID NO: 75736 - RNA, 30 nt, Artificial Sequence
  Alpha-aminoadipic semialdehyde dehydrogenase (196-205)
agccugaucuccguggccgucaccaagauu

SEQ ID NO: 75737 - RNA, 30 nt, Artificial Sequence
  Endonuclease G, mitochondrial (288-297)
agccugaaggccaucaccgcuggcuccaaa

SEQ ID NO: 75738 - RNA, 27 nt, Artificial Sequence
  Cysteine protease ATG4C (177-185)
agccugaaggagaccaucggcaaauac

SEQ ID NO: 75739 - RNA, 27 nt, Artificial Sequence
  DNA-directed RNA polymerase II subunit RPB11-a (99-107)
agccugcucgaggaaagauucagggug

SEQ ID NO: 75740 - RNA, 27 nt, Artificial Sequence
  Nuclear receptor subfamily 4 group A member 3 (230-238)
agccugcucggcgagucccccucucuu

SEQ ID NO: 75741 - RNA, 27 nt, Artificial Sequence
  Protein naked cuticle homolog 1 (158-166)
agccugcuccacaccaucuacgaggug

SEQ ID NO: 75742 - RNA, 30 nt, Artificial Sequence; identical to SEQ ID NO: 51515
  IL6ST nirs variant 1 (26-35)

SEQ ID NO: 75743 - RNA, 27 nt, Artificial Sequence
  Protein transport protein Sec23A (156-164)
agccugcuccccccuaccgcccuugug

SEQ ID NO: 75744 - RNA, 30 nt, Artificial Sequence
  E3 ubiquitin-protein ligase UBR1 (683-692)
agccugauggaccccaacaaguuccuccuu

SEQ ID NO: 75745 - RNA, 36 nt, Artificial Sequence
  Abhydrolase domain-containing protein 2 (299-310)
agccugaugcagaucgacgauaacgugaugagaaag

SEQ ID NO: 75746 - RNA, 27 nt, Artificial Sequence
  Fatty acid synthase (1570-1578)
agccugaacuucagagacaucaugcuc

SEQ ID NO: 75747 - RNA, 27 nt, Artificial Sequence
  Putative segment polarity protein dishevelled homolog DVL1P1 (246-254)
agccugaacaucauuaccgugacacuc

SEQ ID NO: 75748 - RNA, 45 nt, Artificial Sequence
  Integrin alpha-6 (599-613)
agccugcccgaggugcucccuauccuuaacuccgacgaaccaaag

SEQ ID NO: 75749 - RNA, 36 nt, Artificial Sequence
  60S ribosomal protein L38 (59-70)
agccugcccccuggccucgccgugaaggagcuuaaa

SEQ ID NO: 75750 - RNA, 27 nt, Artificial Sequence
  Transcription cofactor HES-6 (44-52)
agccugcaggagcucagacuucuguug

SEQ ID NO: 75751 - RNA, 30 nt, Artificial Sequence
  Anaphase-promoting complex subunit 1 (60-69)
agccugcaggaggugaccauccacgaaaag

SEQ ID NO: 75752 - RNA, 27 nt, Artificial Sequence
  Nestin (24-32)
agccugcagaaggagaaccaagaacuc

SEQ ID NO: 75753 - RNA, 33 nt, Artificial Sequence
  Uncharacterized protein C17orf98 (105-115)
agccugcagcaagugaccggccacgaccauuac

SEQ ID NO: 75754 - RNA, 27 nt, Artificial Sequence
  RING finger protein 10 (254-262)
agccuguccgagaagaccuggucuaaa

SEQ ID NO: 75755 - RNA, 27 nt, Artificial Sequence
  Putative ATP-dependent RNA helicase TDRD12 (1100-1108)
agccugucccagacccccccuagagug

SEQ ID NO: 75756 - RNA, 30 nt, Artificial Sequence
  Alpha-crystallin B chain (129-138)
agccuguccucugacggcgugcucaccguc

SEQ ID NO: 75757 - RNA, 27 nt, Artificial Sequence
  PWWP domain-containing protein MUM1 (280-288)
agccugaccgcccccccugcuccagag

SEQ ID NO: 75758 - RNA, 30 nt, Artificial Sequence
  Probable ATP-dependent RNA helicase DHX40 (351-360)
agccugaccaucgacggcauuagauacgug

SEQ ID NO: 75759 - RNA, 33 nt, Artificial Sequence
  Integrator complex subunit 7 (196-206)
agccugguggacacccccaagcagauccaacuc

SEQ ID NO: 75760 - RNA, 30 nt, Artificial Sequence
  Transcobalamin-1 (223-232)
agccugguggagaagauccucuccgaaaaa

SEQ ID NO: 75761 - RNA, 33 nt, Artificial Sequence
  Vacuolar protein sorting-associated protein 41 homolog (618-628)
agccuguacgccgaguaugacagacccaaccuc

SEQ ID NO: 75762 - RNA, 33 nt, Artificial Sequence
  Spermine synthase (309-319)
agccuguacgaggaacagcucggcagacuuuau

SEQ ID NO: 75763 - RNA, 33 nt, Artificial Sequence; identical to SEQ ID NO: 51536
  General transcription factor 3C polypeptide 3 (259-269)

SEQ ID NO: 75764 - RNA, 27 nt, Artificial Sequence
  COP9 signalosome complex subunit 3 (281-289)
agccuguacaagaaaaacauccagaga

SEQ ID NO: 75765 - RNA, 30 nt, Artificial Sequence
  P2X purinoceptor 7 (286-295)
agccuguaccccggcuauaacuucagauac

SEQ ID NO: 75766 - RNA, 27 nt, Artificial Sequence
  Death-inducer obliterator 1 (1135-1143)
agccuguacuccuauuucucuucaaga

SEQ ID NO: 75767 - RNA, 30 nt, Artificial Sequence
  Protein prune homolog 2 (269-278)
agccuguacaccgaggacaugacacagaag

SEQ ID NO: 75768 - RNA, 27 nt, Artificial Sequence
  Protein argonaute-2 (566-574)
agcauggacgcccaccccaacagauac

SEQ ID NO: 75769 - RNA, 27 nt, Artificial Sequence
  Protein argonaute-1 (615-623)
agcauggacgcccaccccuccagauac

SEQ ID NO: 75770 - RNA, 27 nt, Artificial Sequence
  5,6-dihydroxyindole-2-carboxylic acid oxidase (506-514)
agcauggacgaggccaaccagccccug

SEQ ID NO: 75771 - RNA, 30 nt, Artificial Sequence
  Kinesin-like protein KIF13A (63-72)
agcauggacgaguccaacaccacaaaguac

SEQ ID NO: 75772 - RNA, 27 nt, Artificial Sequence
  Protein argonaute-4 (609-617)
agcauggacggccaccccuccagauac

SEQ ID NO: 75773 - RNA, 27 nt, Artificial Sequence
  Serine-protein kinase ATM (2549-2557)
agcauggaccacccccaucacacccug

SEQ ID NO: 75774 - RNA, 27 nt, Artificial Sequence
  V-type proton ATPase 116 kDa subunit a isoform 3 (340-348)
agcauggaggaaggcguguccgccguc

SEQ ID NO: 75775 - RNA, 36 nt, Artificial Sequence
  RNA-binding protein EWS (350-361)
agcauguucggcucccccgggggacugagagaggcc

SEQ ID NO: 75776 - RNA, 33 nt, Artificial Sequence
  Ribosome-binding protein 1 (32-42)
agcaugaaggagaccuccuacgaagaggcccug

SEQ ID NO: 75777 - RNA, 30 nt, Artificial Sequence; identical to SEQ ID NO: 51550
  Caprin-1 (376-385)

SEQ ID NO: 75778 - RNA, 27 nt, Artificial Sequence
  Protein GREB1 (500-508)
agcaugcugggcgaggaaauccagcuc

SEQ ID NO: 75779 - RNA, 27 nt, Artificial Sequence
  Cystine/glutamate transporter (330-338)
agcaugaacggcgggguguucgccguc

SEQ ID NO: 75780 - RNA, 30 nt, Artificial Sequence; identical to SEQ ID NO: 51553
  Myosin-10 (371-380)

SEQ ID NO: 75781 - RNA, 27 nt, Artificial Sequence
  T-complex protein 1 subunit alpha (155-163)
agcauguccucuaagaucauuggcaua

SEQ ID NO: 75782 - RNA, 30 nt, Artificial Sequence
  Liprin-alpha-1 (1169-1178)
agcauguccucucccucaaugcagccuaag

SEQ ID NO: 75783 - RNA, 27 nt, Artificial Sequence
  Protein PAT1 homolog 1 (499-507)
agcauguacgacaaccugagaggcaag

SEQ ID NO: 75784 - RNA, 45 nt, Artificial Sequence
  Heterogeneous nuclear ribonucleoprotein A1-like 2 (99-113)
agcaacuucggcgggggagguuccuacaaugacuuuggcaacuau

SEQ ID NO: 75785 - RNA, 27 nt, Artificial Sequence
  Catenin beta-1 (605-613)
agccccaucgagaacauucagagagug

SEQ ID NO: 75786 - RNA, 27 nt, Artificial Sequence
  Pleckstrin homology-like domain family A member 2 (42-50)
agccccagagccaggccuaaggagcug

SEQ ID NO: 75787 - RNA, 30 nt, Artificial Sequence
  Clathrin heavy chain 1 (1427-1436)
agccccagacuggaccacaccagggccgug

SEQ ID NO: 75788 - RNA, 39 nt, Artificial Sequence
  Arginine/serine-rich protein 1 (18-30)
agccccuccaccucuagaucaggcgggaguagcaggcug

SEQ ID NO: 75789 - RNA, 27 nt, Artificial Sequence
  Disabled homolog 2 (471-479)
agccccaccggccagccuacagcccug

SEQ ID NO: 75790 - RNA, 45 nt, Artificial Sequence
  Transgelin-2 (185-199)
agccaggccggcaugaccggguacggaaugcccagacaaauccug

SEQ ID NO: 75791 - RNA, 27 nt, Artificial Sequence
  Transmembrane protein 8A (50-58)
agccaggccccccaaagacuguccuuc

SEQ ID NO: 75792 - RNA, 27 nt, Artificial Sequence
  Serine/threonine-protein phosphatase 4 regulatory subunit 2 (5-13)
agccaguucaagggcuacuuuaucuuc

SEQ ID NO: 75793 - RNA, 36 nt, Artificial Sequence
  Copine-8 (260-271)
agccaguucaacguguacgaggucguuaaucccaag

SEQ ID NO: 75794 - RNA, 30 nt, Artificial Sequence
  Transmembrane protein 131 (402-411)
agccaguucuccggcaagaucaccgugaaa

SEQ ID NO: 75795 - RNA, 27 nt, Artificial Sequence
  Ragulator complex protein LAMTOR1 (73-81)
agccagggcauggagcaacacgaauac

SEQ ID NO: 75796 - RNA, 39 nt, Artificial Sequence
  Catenin alpha-1 (268-280)
agccagcaccaaggcgggggagguggcgagcuggccuac

SEQ ID NO: 75797 - RNA, 27 nt, Artificial Sequence
  Protein NPAT (417-425)
agccagaucuccaccucuauucaaaag

SEQ ID NO: 75798 - RNA, 27 nt, Artificial Sequence
  A-kinase anchor protein 9 (687-695)
agccagaagaucgagaccaugcaauuc

SEQ ID NO: 75799 - RNA, 33 nt, Artificial Sequence
  TSC22 domain family protein 1 (1018-1028)
agccagcuggagcaagaaaacaaucuccuuaag

SEQ ID NO: 75800 - RNA, 27 nt, Artificial Sequence
  Tubulin-specific chaperone E (124-132)
agccagcuguccaagcuccaagaggug

SEQ ID NO: 75801 - RNA, 30 nt, Artificial Sequence
  Phosphatidylinositol-binding clathrin assembly protein (520-529)
agccagaaccaaaaucugcccguggccaag

SEQ ID NO: 75802 - RNA, 30 nt, Artificial Sequence
  Heat shock protein HSP 90-alpha (575-584)
agccagaacagaaagaaacuguccgagcuc

SEQ ID NO: 75803 - RNA, 27 nt, Artificial Sequence
  Clathrin interactor 1 (459-467)
agccagaacaccgacauggugcaaaag

SEQ ID NO: 75804 - RNA, 27 nt, Artificial Sequence
  Rotatin (918-926)
agccagcaauccucucugcucaccgug

SEQ ID NO: 75805 - RNA, 45 nt, Artificial Sequence
  Cold-inducible RNA-binding protein (146-160)
agccaguccggcggguacucugacagaucaaguggagguagcuau

SEQ ID NO: 75806 - RNA, 24 nt, Artificial Sequence
  Neuron navigator 2 (999-1006)
agccagguggagagaaacucccug

SEQ ID NO: 75807 - RNA, 30 nt, Artificial Sequence
  Microtubule-actin cross-linking factor 1 (2589-2598)
agccaggugcaaaaggagcugcaguccauc

SEQ ID NO: 75808 - RNA, 30 nt, Artificial Sequence
  Rho GTPase-activating protein 5 (922-931)
agccaguaccacagacaaaccgagguguuc

SEQ ID NO: 75809 - RNA, 30 nt, Artificial Sequence
  Histone-lysine N-methyltransferase setd3 (208-217)
agccaguacaagaacaccgccagacaauau

SEQ ID NO: 75810 - RNA, 27 nt, Artificial Sequence
  Protein unc-45 homolog A (578-586)
agcagacuggaggaaagguccgugcuc

SEQ ID NO: 75811 - RNA, 51 nt, Artificial Sequence
  ELL-associated factor 1 (232-248)
agcagacccgccguggcuaacggcaccuccaggccucaggggucuaaucaa

SEQ ID NO: 75812 - RNA, 51 nt, Artificial Sequence
  Cold-inducible RNA-binding protein (144-160)
agcagaucccagucuggcggguacucagacaggaguagcggagguuccuau

SEQ ID NO: 75813 - RNA, 27 nt, Artificial Sequence
  Phosphatase and actin regulator (216-224)
agcuccgccaagcccggcccugcucug

SEQ ID NO: 75814 - RNA, 30 nt, Artificial Sequence
  LIM domain-binding protein 3 (265-274)
agcuccgcccccgcuacccacacaucuuac

SEQ ID NO: 75815 - RNA, 27 nt, Artificial Sequence
  Serine incorporator 5 (337-345)
agcuccgacgcccugcagggcagauac

SEQ ID NO: 75816 - RNA, 30 nt, Artificial Sequence; identical to SEQ ID NO: 51589
  F-box-like/WD repeat-containing protein TBL1XR1 (4-13)

SEQ ID NO: 75817 - RNA, 30 nt, Artificial Sequence
  Poly (ADP-ribose) polymerase 1 (4-13)
agcuccgacaagcuguacagaguggaguau

SEQ ID NO: 75818 - RNA, 27 nt, Artificial Sequence
  ATP-dependent RNA helicase DDX18 (602-610)
agcuccgacucuagacaguucucacac

SEQ ID NO: 75819 - RNA, 27 nt, Artificial Sequence
  Heterogeneous nuclear ribonucleoprotein H2 (441-449)
agcuccgacuaccagucuaaccuggcc

SEQ ID NO: 75820 - RNA, 33 nt, Artificial Sequence
  Tyrosinase (146-156)
agcuccgacuacgugauccccauuggcaccuau

SEQ ID NO: 75821 - RNA, 27 nt, Artificial Sequence
  Nesprin-2 (2105-2113)
agcuccgaggccccccuggugcagaag

SEQ ID NO: 75822 - RNA, 33 nt, Artificial Sequence
  Osteopontin (26-36)
agcuccgaggaaaagcagcuguacaacaaauau

SEQ ID NO: 75823 - RNA, 27 nt, Artificial Sequence
  Carbohydrate sulfotransferase 11 (323-331)
agcuccgagcaccagacccaacuguac

SEQ ID NO: 75824 - RNA, 30 nt, Artificial Sequence
  Serine/threonine-protein kinase PLK2 (666-675)
agcuccgagcugaagaacagaauggaauac

SEQ ID NO: 75825 - RNA, 27 nt, Artificial Sequence
  Neuron navigator 2 (1837-1845)
agcuccuucaagcaggccuuuggcaaa

SEQ ID NO: 75826 - RNA, 27 nt, Artificial Sequence
  Protein GREB1 (296-304)
agcuccuucagaccccugcucucuaag

SEQ ID NO: 75827 - RNA, 42 nt, Artificial Sequence
  Keratin, type I cytoskeletal 10 (370-383)
agcuccggcucugugggggagucaaguagcaagggacccaga

SEQ ID NO: 75828 - RNA, 24 nt, Artificial Sequence
  Olfactory receptor 52E1 (66-73)
agcuccaucgaccccggccugucu

SEQ ID NO: 75829 - RNA, 27 nt, Artificial Sequence
  E3 ubiquitin-protein ligase HUWE1 (114-122)
agcuccaucgagcaccugaccacacuc

SEQ ID NO: 75830 - RNA, 27 nt, Artificial Sequence
  Zinc finger FYVE domain-containing protein 16 (841-849)
agcuccauccccucuccugccacccug

SEQ ID NO: 75831 - RNA, 36 nt, Artificial Sequence
  HBS1-like protein (521-532)
agcuccaagcugggcaaaaacucuaauuucgccaag

SEQ ID NO: 75832 - RNA, 33 nt, Artificial Sequence
  Zinc finger protein 43 (404-414)
agcuccaagcugaccgagcacaaacucacacau

SEQ ID NO: 75833 - RNA, 33 nt, Artificial Sequence
  RalBP1-associated Eps domain-containing protein 1 (509-519)
agcucccuggacaugaacagaaccuucacagug

SEQ ID NO: 75834 - RNA, 33 nt, Artificial Sequence
  Chromodomain-helicase-DNA-binding protein 9 (261-271)
agcucccuggaggaaaaccuccuucaccaggug

SEQ ID NO: 75835 - RNA, 33 nt, Artificial Sequence
  Spectrin beta chain, non-erythrocytic 1 (1556-1566)
agcucccugucugccgaggcuaucagacagagg

SEQ ID NO: 75836 - RNA, 33 nt, Artificial Sequence
  Eukaryotic translation initiation factor 3 subunit C-like protein (15-25)
agcucccugucuggcgaggaacucgugaccaag

SEQ ID NO: 75837 - RNA, 30 nt, Artificial Sequence
  COMM domain-containing protein 10 (123-132)
agcuccaugggccaggagaccguggaaaag

SEQ ID NO: 75838 - RNA, 33 nt, Artificial Sequence
  Liprin-alpha-1 (1168-1178)
agcuccaugucuucacccaguaugcagccuaag

SEQ ID NO: 75839 - RNA, 27 nt, Artificial Sequence
  Exostosin-2 (52-60)
agcuccaacgacuggaauguggagaag

SEQ ID NO: 75840 - RNA, 42 nt, Artificial Sequence
  Membrane magnesium transporter 1 (109-122)
agcuccaaccaggacgcccugucuucaaauaccagucucaag

SEQ ID NO: 75841 - RNA, 51 nt, Artificial Sequence
  Vimentin (55-71)
agcucccccggcgggguguacgccaccagaucuucagcugucaggcugcgg

SEQ ID NO: 75842 - RNA, 27 nt, Artificial Sequence
  Coatomer subunit gamma-1 (297-305)
agcucccccaaggccgcucugagauac

SEQ ID NO: 75843 - RNA, 27 nt, Artificial Sequence
  RING finger protein 10 (486-494)
agcucccagcaagagcccaucaccaag

SEQ ID NO: 75844 - RNA, 27 nt, Artificial Sequence
  FERM domain-containing protein 4A (829-837)
agcucccaguacagaaucaaggaguau

SEQ ID NO: 75845 - RNA, 39 nt, Artificial Sequence
  Chondroitin sulfate proteoglycan 4 (1608-1620)
agcuccucugccggcaccgacccccagcugcuccuuuac

SEQ ID NO: 75846 - RNA, 27 nt, Artificial Sequence
  Ankyrin-2 (960-968)
agcuccucucccauccacucaggcuuc

SEQ ID NO: 75847 - RNA, 36 nt, Artificial Sequence
  Reticulon-4 (429-440)
agcuccucuccccuggaggccucaagugugaacuac

SEQ ID NO: 75848 - RNA, 27 nt, Artificial Sequence
  Histone acetyltransferase KAT6A (999-1007)
agcuccucucccccuauccugaccaag

SEQ ID NO: 75849 - RNA, 27 nt, Artificial Sequence
  Heterogeneous nuclear ribonucleoprotein U-like protein 1 (97-105)
agcuccucuagacccaucgugcagaag

SEQ ID NO: 75850 - RNA, 42 nt, Artificial Sequence
  Retinoic acid-induced protein 1 (223-236)
agcuccucugugcagggcgggggacaaggugcccacucauac

SEQ ID NO: 75851 - RNA, 36 nt, Artificial Sequence
  Helicase-like transcription factor (446-457)
agcuccgugcccaccacaaagaaaaagaugcugaaa

SEQ ID NO: 75852 - RNA, 27 nt, Artificial Sequence
  Loss of heterozygosity 12 chromosomal region 1 protein (18-26)
agcuccgugacccccucuccugccaag

SEQ ID NO: 75853 - RNA, 27 nt, Artificial Sequence
  Ral GTPase-activating protein subunit beta (647-655)
agcuccuacgacaagcccaucaccuuc

SEQ ID NO: 75854 - RNA, 27 nt, Artificial Sequence
  Protein kinase C and casein kinase substrate in neurons protein 2 (345-353)
agcuccuacgagaagacccagucuuau

SEQ ID NO: 75855 - RNA, 27 nt, Artificial Sequence
  CD99 antigen-like protein 2 (60-68)
agcuccuacaucucuuaucagcaaaag

SEQ ID NO: 75856 - RNA, 27 nt, Artificial Sequence
  U4/U6 small nuclear ribonucleoprotein Prp31 (226-234)
agcaccgccgcuaagaucaugggcgug

SEQ ID NO: 75857 - RNA, 42 nt, Artificial Sequence
  Heterogeneous nuclear ribonucleoprotein H (363-376)
agcaccgccggcgcuuccgggggagcauacgagcacagauau

SEQ ID NO: 75858 - RNA, 39 nt, Artificial Sequence
  Heterogeneous nuclear ribonucleoprotein H (363-375)
agcaccgccggcgcuuccgggggagcauacgguucucag

SEQ ID NO: 75859 - RNA, 27 nt, Artificial Sequence
  Complement component 1 Q subcomponent-binding protein, mitochondrial (175-183)
agcaccgcccuggagcaccaggaauac

SEQ ID NO: 75860 - RNA, 30 nt, Artificial Sequence
  JmjC domain-containing protein 8 (89-98)
agcaccgccaacacauacuccuaucacaag

SEQ ID NO: 75861 - RNA, 36 nt, Artificial Sequence
  Transcription initiation factor TFIID subunit 6 (584-595)
agcaccgcccccuccggcccugggucugugcagaag

SEQ ID NO: 75862 - RNA, 30 nt, Artificial Sequence
  IQ motif and SEC7 domain-containing protein 2 (10-19)
agcaccgccucccacacacugcaucaguac

SEQ ID NO: 75863 - RNA, 27 nt, Artificial Sequence
  116 kDa U5 small nuclear ribonucleoprotein component (483-491)
agcaccgacgauggcgugcaguuccac

SEQ ID NO: 75864 - RNA, 24 nt, Artificial Sequence
  Neuropilin-2 (829-836)
agcaccgacaaggagaaauccugg

SEQ ID NO: 75865 - RNA, 30 nt, Artificial Sequence
  Immunoglobulin superfamily member 3 (124-133)
agcaccgacaagcaguacuucggcuccuau

SEQ ID NO: 75866 - RNA, 30 nt, Artificial Sequence
  Transcription initiation factor TFIID subunit 7-like (113-122)
agcaccgaccccaacaucgugagaaagaaa

SEQ ID NO: 75867 - RNA, 33 nt, Artificial Sequence
  Transcription factor HES-1 (101-111)
agcaccgaccccuccgugcugggcaaguacaga

SEQ ID NO: 75868 - RNA, 39 nt, Artificial Sequence
  RNA-binding protein FUS (44-56)
agcaccgacacauccggcuacgggcagucuucauauagu

SEQ ID NO: 75869 - RNA, 30 nt, Artificial Sequence
  Latent-transforming growth factor beta-binding protein 2 (1572-1581)
agcaccgaggaccugcccgaucacgacauc

SEQ ID NO: 75870 - RNA, 33 nt, Artificial Sequence
  Baculoviral IAP repeat-containing protein 6 (2019-2029)
agcaccgagcagcugagaacaaucauuagguac

SEQ ID NO: 75871 - RNA, 27 nt, Artificial Sequence
  Cathepsin L1 (287-295)
agcaccgaguccgacaacaauaaguac

SEQ ID NO: 75872 - RNA, 42 nt, Artificial Sequence
  DNA-dependent protein kinase catalytic subunit (1861-1874)
agcaccuucgacacacagaucacuaagaaaaugggcuacuau

SEQ ID NO: 75873 - RNA, 33 nt, Artificial Sequence
  Zinc finger protein 280B (174-184)
agcaccuucgaggugaacuccaucaaucccaag

SEQ ID NO: 75874 - RNA, 27 nt, Artificial Sequence
  Brain-specific angiogenesis inhibitor 1-associated protein 2-like protein 1 (460-468)
agcaccuucaaggcccccgcuuccaaa

SEQ ID NO: 75875 - RNA, 30 nt, Artificial Sequence
  Sex comb on midleg-like protein 4 (11-20)
agcaccuucaaccacagaggcucccugcau

SEQ ID NO: 75876 - RNA, 27 nt, Artificial Sequence
  Transmembrane emp24 domain-containing protein 3 (107-115)
agcaccuucucccacaagacaguguac

SEQ ID NO: 75877 - RNA, 27 nt, Artificial Sequence
  Alstrom syndrome protein 1 (1095-1103)
agcaccuucuacucccagagagagaag

SEQ ID NO: 75878 - RNA, 30 nt, Artificial Sequence
  Protein FAM91A1 (429-438)
agcaccggcgagggggaagcccagagauac

SEQ ID NO: 75879 - RNA, 27 nt, Artificial Sequence
  N-acetylglucosamine-1-phosphodiester alpha-N-acetylglucosaminidase (4-12)
agcaccggcagauggcugcuccuuagg

SEQ ID NO: 75880 - RNA, 27 nt, Artificial Sequence
  Vacuolar protein sorting-associated protein 16 homolog (322-330)
agcacccacgaguuccugcaugaagug

SEQ ID NO: 75881 - RNA, 27 nt, Artificial Sequence
  Bifunctional lysine-specific demethylase and histidyl-hydroxylase MINA (251-259)
agcacccacgugacaaucuccacuuac

SEQ ID NO: 75882 - RNA, 30 nt, Artificial Sequence
  Clathrin interactor 1 (210-219)
agcaccaucgacgauacaauuuccaaguuc

SEQ ID NO: 75883 - RNA, 27 nt, Artificial Sequence
  Prolyl 4-hydroxylase subunit alpha-1 (200-208)
agcaccaucgacaagguguccguccug

SEQ ID NO: 75884 - RNA, 30 nt, Artificial Sequence; identical to SEQ ID NO: 51657
  EPB41 protein (372-381)

SEQ ID NO: 75885 - RNA, 27 nt, Artificial Sequence
  Calcium-independent phospholipase A2-gamma (310-318)
agcaccaagcaguccaucgccaacuuc

SEQ ID NO: 75886 - RNA, 27 nt, Artificial Sequence
  Kanadaptin (547-555)
agcacccuggacggcguguccagaaag

SEQ ID NO: 75887 - RNA, 30 nt, Artificial Sequence
  Serologically defined colon cancer antigen 8 (8-17)
agcacccuggaggaaauccucggccaguac

SEQ ID NO: 75888 - RNA, 27 nt, Artificial Sequence
  Serine-protein kinase ATM (934-942)
agcacccuggagcccacaaagucccuc

SEQ ID NO: 75889 - RNA, 33 nt, Artificial Sequence; identical to SEQ ID NO: 51662
  DNA-directed RNA polymerase I subunit RPA1 (376-386)

SEQ ID NO: 75890 - RNA, 27 nt, Artificial Sequence
  Myb-related protein B (600-608)
agcacccugcccaagucccucucucuu

SEQ ID NO: 75891 - RNA, 30 nt, Artificial Sequence
  Zinc finger protein 212 (21-30)
agcacccugcccucccaggccacagagaag

SEQ ID NO: 75892 - RNA, 39 nt, Artificial Sequence
  Myelin basic protein (20-32)
agcaccauggaccacgccagacauggcuuccugcccagg

SEQ ID NO: 75893 - RNA, 27 nt, Artificial Sequence
  Coatomer subunit gamma-1 (134-142)
agcaccaugcugcaggccaucgagaga

SEQ ID NO: 75894 - RNA, 27 nt, Artificial Sequence
  SHC SH2 domain-binding protein 1 (299-307)
agcaccaugauggccggccugcucaga

SEQ ID NO: 75895 - RNA, 27 nt, Artificial Sequence
  Forkhead box protein O1 (544-552)
agcaccaugccccacacauccggcaug

SEQ ID NO: 75896 - RNA, 27 nt, Artificial Sequence
  Transmembrane protein 248 (87-95)
agcaccaugacauccggccaggccaga

SEQ ID NO: 75897 - RNA, 27 nt, Artificial Sequence
  Calcium uptake protein 1, mitochondrial (122-130)
agcacccccgacaagaucuucagauac

SEQ ID NO: 75898 - RNA, 30 nt, Artificial Sequence
  C-Jun-amino-terminal kinase-interacting protein 4 (350-359)
agcacccccacaaagggcaucgagaacaaa

SEQ ID NO: 75899 - RNA, 27 nt, Artificial Sequence
  Transcription elongation factor A protein 1 (135-143)
agcaccuccgacucugugagacugaag

SEQ ID NO: 75900 - RNA, 30 nt, Artificial Sequence
  LisH domain-containing protein ARMC9 (382-391)
agcaccuccgacguggucagacaguacaug

SEQ ID NO: 75901 - RNA, 33 nt, Artificial Sequence; identical to SEQ ID NO: 51674
  Endoplasmin (187-197)

SEQ ID NO: 75902 - RNA, 27 nt, Artificial Sequence
  Enhancer of mRNA-decapping protein 4 (165-173)
agcaccuccgagagaacacugcucaag

SEQ ID NO: 75903 - RNA, 27 nt, Artificial Sequence
  Versican core protein (1942-1950)
agcaccgugucccaccccaucgccaag

SEQ ID NO: 75904 - RNA, 27 nt, Artificial Sequence
  E3 ubiquitin-protein ligase ZNRF1 (95-103)
agcaccuacgcccacggcaacggguau

SEQ ID NO: 75905 - RNA, 39 nt, Artificial Sequence
  Epithelial discoidin domain-containing receptor 1 (213-225)
agcaccuacgacggccacacaguggggggacugcaguau

SEQ ID NO: 75906 - RNA, 30 nt, Artificial Sequence
  Regulator of microtubule dynamics protein 1 (239-248)
agcaccuacgagaaggcccugggcuauuuc

SEQ ID NO: 75907 - RNA, 27 nt, Artificial Sequence
  Zinc finger protein 627 (490-498)
agcaccuacuucagagugcacgagaag

SEQ ID NO: 75908 - RNA, 33 nt, Artificial Sequence
  Heat shock protein HSP 90-alpha (724-734)
agcaccuacggcuggacagccaacauggagaga

SEQ ID NO: 75909 - RNA, 27 nt, Artificial Sequence
  Phosphomevalonate kinase (66-74)
agcaccuacaaggaggccuucagaaaa

SEQ ID NO: 75910 - RNA, 33 nt, Artificial Sequence
  Acid ceramidase (33-43)
agcaccuaccccccuuccggcccaacauauaga

SEQ ID NO: 75911 - RNA, 33 nt, Artificial Sequence
  Mitochondrial basic amino acids transporter (140-150)
agcaccuaccccguggacgucguuaaguccaga

SEQ ID NO: 75912 - RNA, 30 nt, Artificial Sequence
  Protein tweety homolog 2 (519-528)
agcguggccgacgagcaccugagacauuac

SEQ ID NO: 75913 - RNA, 33 nt, Artificial Sequence
  BMP-2-inducible protein kinase (599-609)
agcguggccgacaaggaggcuaucgcaaacuuc

SEQ ID NO: 75914 - RNA, 27 nt, Artificial Sequence
  Adenomatous polyposis coli protein 2 (774-782)
agcguggccuccaaggcucugcagaaa

SEQ ID NO: 75915 - RNA, 33 nt, Artificial Sequence
  Dolichyl-diphosphooligosaccharide-proteinosyltransferase subunit 2 (312-322)
agcguggccuccagagcuaccguccugcagaag

SEQ ID NO: 75916 - RNA, 30 nt, Artificial Sequence
  DNA-directed RNA polymerase III subunit RPC5 (347-356)
agcguggccguccugagaggcauccagaag

SEQ ID NO: 75917 - RNA, 27 nt, Artificial Sequence
  Epididymal secretory protein E1 (29-37)
agcguggacggcgucaucaaggagguu

SEQ ID NO: 75918 - RNA, 33 nt, Artificial Sequence
  Chromodomain-helicase-DNA-binding protein 4 (628-638)
agcguggacaagaaaggccacguccauuaccug

SEQ ID NO: 75919 - RNA, 30 nt, Artificial Sequence
  U3 small nucleolar ribonucleoprotein protein MPP10 (594-603)
agcguggaccaggccggcaaguacuccaaa

SEQ ID NO: 75920 - RNA, 30 nt, Artificial Sequence
  Nucleolar protein 11 (28-37)
agcguggacagaaaguucaucucccugaug

SEQ ID NO: 75921 - RNA, 30 nt, Artificial Sequence
  Peroxisomal multifunctional enzyme type 2 (75-84)
agcguggaggaaggcgagaaggucguuaaa

SEQ ID NO: 75922 - RNA, 33 nt, Artificial Sequence
  Cytochrome c oxidase subunit 7C, mitochondrial (30-40)
agcguggagaacaaguggucccugcucgccaaa

SEQ ID NO: 75923 - RNA, 33 nt, Artificial Sequence
  Histone acetyltransferase KAT7 (249-259)
agcguguucgaggucgacggcaagaaaaacaag

SEQ ID NO: 75924 - RNA, 36 nt, Artificial Sequence
  Receptor-type tyrosine-protein phosphatase zeta (1032-1043)
agcguguucggcgacgauaacaaggcccuguccaaa

SEQ ID NO: 75925 - RNA, 39 nt, Artificial Sequence
  Calcium-binding mitochondrial carrier protein SCaMC-2 (37-49)
agcguguucauccccucccaggaguuuucuaccuacaga

SEQ ID NO: 75926 - RNA, 30 nt, Artificial Sequence
  LIX1-like protein (121-130)
agcguguucaacgagcaccccuccagaagg

SEQ ID NO: 75927 - RNA, 27 nt, Artificial Sequence
  Ras-associated and pleckstrin homology domains-containing protein 1 (627-635)
agcguguucuccgaggccuggaagaga

SEQ ID NO: 75928 - RNA, 36 nt, Artificial Sequence
  Formin-1 (1148-1159)
agcguguucuccgagggcaucaccucucugcacaga

SEQ ID NO: 75929 - RNA, 27 nt, Artificial Sequence
  Transcription activator BRG1 (1587-1595)
agcguguucaccuccgucagacagaag

SEQ ID NO: 75930 - RNA, 33 nt, Artificial Sequence
  Ras-related protein Rab-6B (23-33)
agcgugggcaagaccucccugaucacaagauuc

SEQ ID NO: 75931 - RNA, 27 nt, Artificial Sequence
  Rho guanine nucleotide exchange factor 17 (885-893)
agcgugaucgacaccgccuccaaguac

SEQ ID NO: 75932 - RNA, 27 nt, Artificial Sequence
  Transmembrane emp24 domain-containing protein 7 (151-159)
agcgugaucgacuaccagacccacuuc

SEQ ID NO: 75933 - RNA, 30 nt, Artificial Sequence
  BTB/POZ domain-containing protein 9 (367-376)
agcgugaucgagggcgucuccagaucuagg

SEQ ID NO: 75934 - RNA, 30 nt, Artificial Sequence
  Protein dopey-2 (19-28)
agcgugaucgagaaggcccugagaaacuuc

SEQ ID NO: 75935 - RNA, 27 nt, Artificial Sequence
  Inactive phospholipase C-like protein 1 (372-380)
agcgugaucgaggucauuaacaaguuc

SEQ ID NO: 75936 - RNA, 27 nt, Artificial Sequence
  Carbohydrate sulfotransferase 10 (278-286)
agcgugaucggccaccaugagacccug

SEQ ID NO: 75937 - RNA, 27 nt, Artificial Sequence
  E3 ubiquitin-protein ligase RBBP6 (1347-1355)
agcgugaucaagaacgucuccaccaaa

SEQ ID NO: 75938 - RNA, 30 nt, Artificial Sequence
  FERM domain-containing protein 6 (60-69)
agcgugauccagaacaaugagcacgucuac

SEQ ID NO: 75939 - RNA, 30 nt, Artificial Sequence
  Vacuolar protein sorting-associated protein 11 homolog (769-778)
agcgugaucagagacuaccugguccagaag

SEQ ID NO: 75940 - RNA, 30 nt, Artificial Sequence
  Choline kinase alpha (114-123)
agcgugaucagaggcgggcuguccaacaug

SEQ ID NO: 75941 - RNA, 33 nt, Artificial Sequence
  Lipid phosphate phosphatase-related protein type 3 (109-119)
agcgugaucuccgacaccacaaagcugcucaaa

SEQ ID NO: 75942 - RNA, 30 nt, Artificial Sequence; identical to SEQ ID NO: 51715
  E3 ubiquitin-protein ligase MYCBP2 (613-622)

SEQ ID NO: 75943 - RNA, 33 nt, Artificial Sequence
  ATPase family AAA domain-containing protein 2 (1033-1043)
agcgugaucuccaagauugaccugcacaaauac

SEQ ID NO: 75944 - RNA, 27 nt, Artificial Sequence
  Pro-interleukin-16 (212-220)
agcgugaucuccaacauuguccugaug

SEQ ID NO: 75945 - RNA, 30 nt, Artificial Sequence
  Dolichyl-diphosphooligosaccharide-proteinosyltransferase subunit DAD1 (7-16)
agcgugaucuccagauuccuggaggaauac

SEQ ID NO: 75946 - RNA, 30 nt, Artificial Sequence
  Fanconi anemia group A protein (283-292)
agcgugaucuccaccgacccccugaagaga

SEQ ID NO: 75947 - RNA, 27 nt, Artificial Sequence
  Vacuolar protein sorting-associated protein 13C (3201-3209)
agcgugaucaccagauucaacgaguac

SEQ ID NO: 75948 - RNA, 27 nt, Artificial Sequence
  Acyl-CoA dehydrogenase family member 9, mitochondrial (237-245)
agcgugaaggacaaaaucaccgccuuc

SEQ ID NO: 75949 - RNA, 42 nt, Artificial Sequence
  Ran-specific GTPase-activating protein (187-200)
agcgugaaggaggaaaccaaagaggacgccgaagagaagcag

SEQ ID NO: 75950 - RNA, 42 nt, Artificial Sequence
  39S ribosomal protein L48, mitochondrial (94-107)
agcgugaaggagcacaccgaagaggacuucaaaggcagauuu

SEQ ID NO: 75951 - RNA, 27 nt, Artificial Sequence
  CTP synthase 1 (225-233)
agcgugaaggagaaaaucuccauguuc

SEQ ID NO: 75952 - RNA, 27 nt, Artificial Sequence
  Amyloid protein-binding protein 2 (95-103)
agcgugcuggccuacuccuucucuaga

SEQ ID NO: 75953 - RNA, 33 nt, Artificial Sequence
  Cytoplasmic dynein 1 heavy chain 1 (2317-2327)
agcgugcuggacgauaacaagcuccuuacccug

SEQ ID NO: 75954 - RNA, 27 nt, Artificial Sequence
  Interferon-induced GTP-binding protein Mx1 (85-93)
agcgugcuggaggcccucuccggcguc

SEQ ID NO: 75955 - RNA, 36 nt, Artificial Sequence
  Protein fem-1 homolog B (414-425)
agcgugcuggagaucgaacaguccaugaacagaguc

SEQ ID NO: 75956 - RNA, 27 nt, Artificial Sequence
  Zinc finger MYM-type protein 6 (648-656)
agcgugcugaagggcgccgucaccaaa

SEQ ID NO: 75957 - RNA, 27 nt, Artificial Sequence
  Pre-rRNA-processing protein TSR1 homolog (547-555)
agcgugcugaacauggucguuagaagg

SEQ ID NO: 75958 - RNA, 30 nt, Artificial Sequence; identical to SEQ ID NO: 51731
  Protein tweety homolog 3 (286-295)

SEQ ID NO: 75959 - RNA, 27 nt, Artificial Sequence
  Interleukin-1 receptor-associated kinase 1 (94-102)
agcgugcuguggcccuggaucaacaga

SEQ ID NO: 75960 - RNA, 36 nt, Artificial Sequence
  Heat shock 70 kDa protein 14 (206-217)
agcgugauggaggucaacuccggcaucuacagaguu

SEQ ID NO: 75961 - RNA, 33 nt, Artificial Sequence
  Synaptonemal complex protein SC65 (327-337)
agcgugaugcagcaaaaccuggucuacuauaga

SEQ ID NO: 75962 - RNA, 27 nt, Artificial Sequence
  DNA replication licensing factor MCM5 (417-425)
agcgugaugagagaccccuccucuagg

SEQ ID NO: 75963 - RNA, 30 nt, Artificial Sequence
  V-type proton ATPase 16 kDa proteolipid subunit (45-54)
agcgugaugagacccgagcagaucaugaag

SEQ ID NO: 75964 - RNA, 27 nt, Artificial Sequence
  Propionyl-CoA carboxylase beta chain, mitochondrial (34-42)
agcgugaacgagagaaucgaaaauaag

SEQ ID NO: 75965 - RNA, 36 nt, Artificial Sequence
  A-kinase-interacting protein 1 (106-117)
agcgugcccgaggaaggcggggccacccacgucuac

SEQ ID NO: 75966 - RNA, 36 nt, Artificial Sequence
  Melanocyte protein PMEL (633-644)
agcgugccccagcugccucacuccucuucacauugg

SEQ ID NO: 75967 - RNA, 30 nt, Artificial Sequence
  Nuclear distribution protein nudE homolog 1 (211-220)
agcgugcccuccaccccuaucgcccacaga

SEQ ID NO: 75968 - RNA, 30 nt, Artificial Sequence
  Krueppel-like factor 5 (213-222)
agcgugcccacccagcaaggccaccuguac

SEQ ID NO: 75969 - RNA, 36 nt, Artificial Sequence
  Retinoic acid-induced protein 1 (225-236)
agcgugcagggcgggggacaaggugcccacuccuac

SEQ ID NO: 75970 - RNA, 33 nt, Artificial Sequence
  Bcl-2-related protein A1 (43-53)
agcgugcagaaggaggucgaaaaaaaccugaag

SEQ ID NO: 75971 - RNA, 27 nt, Artificial Sequence
  UDP-glucose 4-epimerase (97-105)
agcgugcagaagccccuggacuacuau

SEQ ID NO: 75972 - RNA, 27 nt, Artificial Sequence
  40S ribosomal protein S16 (9-17)
agcgugcaggucuucggcagaaagaaa

SEQ ID NO: 75973 - RNA, 27 nt, Artificial Sequence
  Serine/threonine-protein kinase 4 (109-117)
agcguguccgacaucauuagacugagg

SEQ ID NO: 75974 - RNA, 27 nt, Artificial Sequence
  Zinc transporter ZIP6 (243-251)
agcguguccgagcccagaaagggcuuc

SEQ ID NO: 75975 - RNA, 30 nt, Artificial Sequence
  MICOS complex subunit MIC60 (113-122)
agcguguccgaggucaugaaggaaucuaaa

SEQ ID NO: 75976 - RNA, 36 nt, Artificial Sequence
  CDC42 small effector protein 2 (51-62)
agcguguccucuauccagaaccaaaugcagucaaag

SEQ ID NO: 75977 - RNA, 27 nt, Artificial Sequence
  Vimentin (5-13)
agcguguccucuucaaguuacagaagg

SEQ ID NO: 75978 - RNA, 27 nt, Artificial Sequence
  Shootin-1 (9-17)
agcgugaccaagacagcccugaacaaa

SEQ ID NO: 75979 - RNA, 33 nt, Artificial Sequence
  LON peptidase N-terminal domain and RING finger protein 2 (607-617)
agcguggucgacgccaucggcauuuccagauuc

SEQ ID NO: 75980 - RNA, 27 nt, Artificial Sequence
  Phosphatidylinositol 3-kinase regulatory subunit beta (397-405)
agcguggucgaccugaucaaccacuac

SEQ ID NO: 75981 - RNA, 27 nt, Artificial Sequence
  GRAM domain-containing protein 1A (439-447)
agcguggucgagacccagacacuguuc

SEQ ID NO: 75982 - RNA, 30 nt, Artificial Sequence
  Unconventional myosin-VI (74-83)
agcguggucggcggguucguuucccacuac

SEQ ID NO: 75983 - RNA, 33 nt, Artificial Sequence
  Elongator complex protein 1 (1171-1181)
agcguggucuccggcucugagaugucagggaag

SEQ ID NO: 75984 - RNA, 33 nt, Artificial Sequence
  DNA dC-dU-editing enzyme APOBEC-3C (46-56)
agcguggucuccuggaagaccggcguuuucaga

SEQ ID NO: 75985 - RNA, 27 nt, Artificial Sequence
  Centrosomal protein of 131 kDa (47-55)
agcguggucaccggcuccgagcagaag

SEQ ID NO: 75986 - RNA, 27 nt, Artificial Sequence
  Discoidin domain-containing receptor 2 (215-223)
agcguguacgacggcgccgucggguau

SEQ ID NO: 75987 - RNA, 30 nt, Artificial Sequence
  Exocyst complex component 6B (39-48)
agcguguacgacggcgaggaacacgggaga

SEQ ID NO: 75988 - RNA, 39 nt, Artificial Sequence
  Serum paraoxonase/arylesterase 2 (334-346)
agcguguacgacggcaagcugcucaucgggacccuuuau

SEQ ID NO: 75989 - RNA, 30 nt, Artificial Sequence
  DNA-binding protein RFX7 (1307-1316)
agcguguacgaguuccagacccccuccuau

SEQ ID NO: 75990 - RNA, 30 nt, Artificial Sequence
  Far upstream element-binding protein 3 (77-86)
agcguguacggcuaugggguccagaagaga

SEQ ID NO: 75991 - RNA, 33 nt, Artificial Sequence
  Nuclear cap-binding protein subunit 1 (280-290)
agcguguaccccaugccuagagucaucuucagg

SEQ ID NO: 75992 - RNA, 33 nt, Artificial Sequence
  Inositol hexakisphosphate and diphosphoinositol-pentakisphosphate kinase 2 (220-230)
agcguguacucccccgagucuaacgucagaaag

SEQ ID NO: 75993 - RNA, 30 nt, Artificial Sequence
  Golgi resident protein GCP60 (519-528)
agcguguacuauagagucuacuauaccagg

SEQ ID NO: 75994 - RNA, 27 nt, Artificial Sequence
  T-box transcription factor TBX2 (536-544)
accgccgcucccuucccuuuucaccug

SEQ ID NO: 75995 - RNA, 33 nt, Artificial Sequence
  Transducin beta-like protein 3 (197-207)
accgccgaccacaaccugcuccuuuacgaggcu

SEQ ID NO: 75996 - RNA, 27 nt, Artificial Sequence
  Protein bicaudal D homolog 2 (465-473)
accgccgagguggcucuggcaaaccuc

SEQ ID NO: 75997 - RNA, 27 nt, Artificial Sequence
  Unconventional myosin-X (353-361)
accgcccugggcagaagcgcugagcuc

SEQ ID NO: 75998 - RNA, 27 nt, Artificial Sequence
  Homeodomain-interacting protein kinase 3 (308-316)
accgcccugaagaaacucaagagccuu

SEQ ID NO: 75999 - RNA, 27 nt, Artificial Sequence
  Protein S100-A1 (7-15)
accgccauggagacacugaucaacgug

SEQ ID NO: 76000 - RNA, 33 nt, Artificial Sequence
  Ankycorbin (72-82)
accgcccaggacacaacuggccacagcgcucug

SEQ ID NO: 76001 - RNA, 48 nt, Artificial Sequence
  Presequence protease, mitochondrial (707-722)
accgcccaggagcuggcuaacggcauccccgacagcgggcaccucuac

SEQ ID NO: 76002 - RNA, 21 nt, Artificial Sequence
  Nuclear pore complex-interacting protein (238-244)
accgacaacagccugucccuc

SEQ ID NO: 76003 - RNA, 30 nt, Artificial Sequence
  Interleukin-1 receptor accessory protein (307-316)
accgaggacgaaacaagaacucagauccug

SEQ ID NO: 76004 - RNA, 30 nt, Artificial Sequence
  Uncharacterized membrane protein C19orf24 (108-117)
accgaggaccccacagaaauggccagccug

SEQ ID NO: 76005 - RNA, 27 nt, Artificial Sequence
  Quinone oxidoreductase (182-190)
accgaggaaggccagaagaucgugcug

SEQ ID NO: 76006 - RNA, 30 nt, Artificial Sequence
  Proteasome activator complex subunit 3 (220-229)
accgagaucgacgaaaaggaguacauuagc

SEQ ID NO: 76007 - RNA, 27 nt, Artificial Sequence
  Ventricular zone-expressed PH domain-containing protein homolog 1 (7-15)
accgagaucgaauuccccgagaagcug

SEQ ID NO: 76008 - RNA, 27 nt, Artificial Sequence
  RNA-binding protein 12 (77-85)
accgagaugcagaacaugaucgaacug

SEQ ID NO: 76009 - RNA, 27 nt, Artificial Sequence
  Pre-mRNA-processing-splicing factor 8 (945-953)
accgagcccccuccacugcucguguac

SEQ ID NO: 76010 - RNA, 27 nt, Artificial Sequence
  Probable N-acetyltransferase 16 (59-67)
accgagagagaauucgaggaagugcug

SEQ ID NO: 76011 - RNA, 27 nt, Artificial Sequence
  Major facilitator superfamily domain-containing protein 1 (327-335)
accggcaagaacaucauuugggugcug

SEQ ID NO: 76012 - RNA, 27 nt, Artificial Sequence
  DNA topoisomerase 2-alpha (1397-1405)
acccacuuccccgacgagacagaaauc

SEQ ID NO: 76013 - RNA, 30 nt, Artificial Sequence
  Mothers against decapentaplegic homolog 2 (197-206)
acccacagcauccccgagaacacaaauuuc

SEQ ID NO: 76014 - RNA, 30 nt, Artificial Sequence
  Sorting nexin-18 (279-288)
accaucgacgaucccacaaagcagacuaaa

SEQ ID NO: 76015 - RNA, 33 nt, Artificial Sequence
  Plastin-2 (117-127)
accaucgacgagagaacaauuaacaagaaaaag

SEQ ID NO: 76016 - RNA, 27 nt, Artificial Sequence
  MAM and LDL-receptor class A domain-containing protein 1 (1829-1837)
accaucgaggaaagcggccugaacauu

SEQ ID NO: 76017 - RNA, 30 nt, Artificial Sequence
  NADH-ubiquinone oxidoreductase chain 2 (12-21)
accaucuucgccggcacacugauuacugcu

SEQ ID NO: 76018 - RNA, 27 nt, Artificial Sequence
  DBH-like monooxygenase protein 1 (50-58)
accaucauugaguucacaagagaacug

SEQ ID NO: 76019 - RNA, 27 nt, Artificial Sequence
  Cytoskeleton-associated protein 5 (365-373)
accauccuggagaaguucaaagaaaag

SEQ ID NO: 76020 - RNA, 48 nt, Artificial Sequence
  Melanocyte protein PMEL (215-230)
accaucacagaccaggugcccuucagcgucuccguuucucaacugaga

SEQ ID NO: 76021 - RNA, 39 nt, Artificial Sequence
  Ornithine aminotransferase, mitochondrial (30-42)
accaagaaaacagugcagggccccccuacuagcgacgau

SEQ ID NO: 76022 - RNA, 39 nt, Artificial Sequence
  Catenin delta-1 (790-802)
accaagagccuggacaacaauuacuccacacccaacgag

SEQ ID NO: 76023 - RNA, 30 nt, Artificial Sequence
  Low-density lipoprotein receptor-related protein 1B (701-710)
acccuggacuuccacacaaacacucucuac

SEQ ID NO: 76024 - RNA, 33 nt, Artificial Sequence
  KN motif and ankyrin repeat domain-containing protein 1 (702-712)
acccuggacaagcagacaagcacucaaacggug

SEQ ID NO: 76025 - RNA, 24 nt, Artificial Sequence
  PH and SEC7 domain-containing protein 3 (117-124)
acccuggaccagagccucagauac

SEQ ID NO: 76026 - RNA, 27 nt, Artificial Sequence
  Kinesin-like protein KIF20B (1134-1142)
acccuggacgugcagauccaacacguc

SEQ ID NO: 76027 - RNA, 33 nt, Artificial Sequence
  UPF0505 protein C16orf62 (625-635)
acccuggaggacgaaaagagaaugcucagcuac

SEQ ID NO: 76028 - RNA, 33 nt, Artificial Sequence
  Syndecan-3 (348-358)
acccuggaggaacccaagcaggccagcgugaca

SEQ ID NO: 76029 - RNA, 30 nt, Artificial Sequence
  Biliverdin reductase A (71-80)
acccuggaggaaagaaaggaggaccaguac

SEQ ID NO: 76030 - RNA, 27 nt, Artificial Sequence
  Rap guanine nucleotide exchange factor 6 (4-12)
acccuguuccagaagcucuuuagcaaa

SEQ ID NO: 76031 - RNA, 30 nt, Artificial Sequence
  ATP-dependent RNA helicase DHX36 (503-512)
acccugcacgaccuccuuaugagccaggug

SEQ ID NO: 76032 - RNA, 30 nt, Artificial Sequence
  F-box/WD repeat-containing protein 11 (217-226)
acccugauccaccauaacgaggccgugcuc

SEQ ID NO: 76033 - RNA, 30 nt, Artificial Sequence
  Plexin-C1 (370-379)
acccugauccacagcgaccucacauccgug

SEQ ID NO: 76034 - RNA, 33 nt, Artificial Sequence
  Tetraspanin-14 (239-249)
acccugaucagcgacauugaggccgugaaggcu

SEQ ID NO: 76035 - RNA, 27 nt, Artificial Sequence
  Midasin (462-470)
acccugcucgacaaguacuggacaaaa

SEQ ID NO: 76036 - RNA, 33 nt, Artificial Sequence
  Inositol-tetrakisphosphate 1-kinase (102-112)
acccugcucgacagaagcaaguccuacgagcuu

SEQ ID NO: 76037 - RNA, 27 nt, Artificial Sequence
  Midasin (3030-3038)
acccugcucgaggugggccagaucgcc

SEQ ID NO: 76038 - RNA, 36 nt, Artificial Sequence
  NADH-ubiquinone oxidoreductase chain 4L (39-50)
acccugaugacacucaacacucacagccuucuggcc

SEQ ID NO: 76039 - RNA, 30 nt, Artificial Sequence
  Serine/threonine-protein phosphatase 1 regulatory subunit 10 (169-178)
acccugcccgagagaccucucacagaagug

SEQ ID NO: 76040 - RNA, 27 nt, Artificial Sequence
  Sorting nexin-9 (218-226)
acccugcaggacaagcaaaacauggug

SEQ ID NO: 76041 - RNA, 30 nt, Artificial Sequence
  Olfactory receptor (79-88)
acccuggugggcaacuucacaaucauuaua

SEQ ID NO: 76042 - RNA, 27 nt, Artificial Sequence
  tRNA-dihydrouridine(20) synthase (NAD(P)+)-like (378-386)
acccugugggacaagagcaaaaagcuc

SEQ ID NO: 76043 - RNA, 33 nt, Artificial Sequence
  Spatacsin (451-461)
acccugugggaccucgagacacagggcaugcaa

SEQ ID NO: 76044 - RNA, 27 nt, Artificial Sequence
  E3 SUMO-protein ligase PIAS1 (360-368)
acccuguacauccagaugaacgagaag

SEQ ID NO: 76045 - RNA, 42 nt, Artificial Sequence
  Eukaryotic translation initiation factor 3 subunit D (56-69)
accaacaaguacagcucccaguucggcgggggaucucaauau

SEQ ID NO: 76046 - RNA, 33 nt, Artificial Sequence
  ATP-dependent RNA helicase DDX42 (106-116)
accaaccugacaccccagcaacucaucgaccuu

SEQ ID NO: 76047 - RNA, 27 nt, Artificial Sequence
  Calcium permeable stress-gated cation channel 1 (426-434)
acccccgccaucauuaugaacacaaua

SEQ ID NO: 76048 - RNA, 27 nt, Artificial Sequence
  Neuron navigator 2 (981-989)
acccccgccagcuccagaaagaaccug

SEQ ID NO: 76049 - RNA, 48 nt, Artificial Sequence
  Nucleolin (121-136)
acccccggcaagaaaggggccgcuaucccugcaaagggagccaaaaac

SEQ ID NO: 76050 - RNA, 57 nt, Artificial Sequence
  Nucleolin (121-139)
acccccggcaagaaaggggccgcuaucccugcaaagggagccaaaaacgguaagaau

SEQ ID NO: 76051 - RNA, 36 nt, Artificial Sequence
  Chondroitin sulfate proteoglycan 4 (2310-2321)
acccccaacccugcccugaagaauggccaguacugg

SEQ ID NO: 76052 - RNA, 42 nt, Artificial Sequence
  Alpha-adducin (194-207)
acccccagcuuccugaagaaauccaagaaaaagucugacuca

SEQ ID NO: 76053 - RNA, 27 nt, Artificial Sequence
  GPI ethanolamine phosphate transferase 3 (274-282)
acccaggaccugcaagccaaggagcuc

SEQ ID NO: 76054 - RNA, 30 nt, Artificial Sequence
  Homer protein homolog 3 (100-109)
acccaguucgccgagaaguuucaagaagug

SEQ ID NO: 76055 - RNA, 33 nt, Artificial Sequence
  Hypoxia-inducible factor 1-alpha (123-133)
acccaguucgagcugacaggccacagcguguuu

SEQ ID NO: 76056 - RNA, 33 nt, Artificial Sequence
  Serine-protein kinase ATM (2268-2278)
acccagcugcccgagagagccaucuuccaaauu

SEQ ID NO: 76057 - RNA, 36 nt, Artificial Sequence
  Proteasome subunit beta type-4 (15-26)
acccagaaccccauggugacaggcacuagcguccug

SEQ ID NO: 76058 - RNA, 33 nt, Artificial Sequence
  von Willebrand factor A domain-containing protein 9 (75-85)
acccagaaccaaagaagcgaguccaauagguuc

SEQ ID NO: 76059 - RNA, 39 nt, Artificial Sequence
  Macrophage migration inhibitory factor (22-34)
acccagcaacuggcccaggcuacaggcaagcccccucag

SEQ ID NO: 76060 - RNA, 27 nt, Artificial Sequence
  Gamma-interferon-inducible protein 16 (235-243)
acccagacacaauucuuucacgugaag

SEQ ID NO: 76061 - RNA, 27 nt, Artificial Sequence
  60S ribosomal protein L14 (89-97)
accagaugggccaagaaaaucgaggcu

SEQ ID NO: 76062 - RNA, 27 nt, Artificial Sequence
  Cadherin-19 (219-227)
accagcgccgagaucagaucccuguac

SEQ ID NO: 76063 - RNA, 30 nt, Artificial Sequence
  WW domain-containing adapter protein with coiled-coil (338-347)
accagcgacgccuccucucccagaucauac

SEQ ID NO: 76064 - RNA, 27 nt, Artificial Sequence
  FAST kinase domain-containing protein 2 (547-555)
accagcgacgauaugaagaacgccuac

SEQ ID NO: 76065 - RNA, 30 nt, Artificial Sequence
  Latent-transforming growth factor beta-binding protein 2 (1043-1052)
accagcgacgagaagggcugccaggaugug

SEQ ID NO: 76066 - RNA, 33 nt, Artificial Sequence
  Trimethyllysine dioxygenase, mitochondrial (224-234)
accagcgacuucuccagaggcgauacagccuac

SEQ ID NO: 76067 - RNA, 33 nt, Artificial Sequence
  Cyclic AMP-dependent transcription factor ATF-6 alpha (429-439)
accagcgacggcaucauucagaagaacuccuac

SEQ ID NO: 76068 - RNA, 27 nt, Artificial Sequence
  L-dopachrome tautomerase (136-144)
accagcgaccagcugggcuacuccuau

SEQ ID NO: 76069 - RNA, 27 nt, Artificial Sequence
  Poly (ADP-ribose) polymerase 11 (22-30)
accagcgacacacaguggggcugguuc

SEQ ID NO: 76070 - RNA, 33 nt, Artificial Sequence
  Endoplasmin (188-198)
accagcgagcugaucggccaguucgggguggga

SEQ ID NO: 76071 - RNA, 36 nt, Artificial Sequence
  Probable ATP-dependent RNA helicase DDX5 (556-567)
accagcuucagaacaggcaaccccacugggacguac

SEQ ID NO: 76072 - RNA, 30 nt, Artificial Sequence
  YTH domain-containing family protein 2 (706-715)
accagcaucuucgacgauuuuucccacuac

SEQ ID NO: 76073 - RNA, 27 nt, Artificial Sequence
  KN motif and ankyrin repeat domain-containing protein 4 (11-19)
accagccugaaguccaucaugaaaaag

SEQ ID NO: 76074 - RNA, 33 nt, Artificial Sequence
  E3 ubiquitin-protein ligase RNF213 (1201-1211)
accagcuccaacucucagagagccacacacuac

SEQ ID NO: 76075 - RNA, 51 nt, Artificial Sequence
  Nestin (511-527)
accagcugggccggcgcucccgugcaccuggggcagggacaauuccucaag

SEQ ID NO: 76076 - RNA, 27 nt, Artificial Sequence
  Probable ATP-dependent RNA helicase YTHDC2 (1212-1220)
accacagccgagagagugcugaugaag

SEQ ID NO: 76077 - RNA, 24 nt, Artificial Sequence
  Junction plakoglobin (287-294)
accacagacugccugcagcuccuu

SEQ ID NO: 76078 - RNA, 27 nt, Artificial Sequence
  Junction plakoglobin (287-295)
accacagacugccugcagcuccuugcc

SEQ ID NO: 76079 - RNA, 33 nt, Artificial Sequence
  Flavin reductaseADPH) (190-200)
accacagacgaguacgauggccacagcacuuau

SEQ ID NO: 76080 - RNA, 27 nt, Artificial Sequence
  ATP-dependent 6-phosphofructokinase, platelet type (379-387)
accacagacuucaucuaccagcuguau

SEQ ID NO: 76081 - RNA, 24 nt, Artificial Sequence
  Probable ATP-dependent RNA helicase DDX60-like (990-997)
accacagacaucauugagaaguac

SEQ ID NO: 76082 - RNA, 33 nt, Artificial Sequence
  Methyl-CpG-binding domain protein 6 (678-688)
accacagaccccggcgccagcucccuggggaag

SEQ ID NO: 76083 - RNA, 30 nt, Artificial Sequence
  IQ domain-containing protein G (71-80)
accacagaccagcugagcauccucaacuac

SEQ ID NO: 76084 - RNA, 27 nt, Artificial Sequence
  Glutamate receptor ionotropic, kainate 5 (78-86)
accacagacacuaugugccagauccug

SEQ ID NO: 76085 - RNA, 27 nt, Artificial Sequence
  Heterogeneous nuclear ribonucleoproteins A2/B1 (20-28)
accacagaggaaagccugagaaacuac

SEQ ID NO: 76086 - RNA, 27 nt, Artificial Sequence
  Apoptosis-stimulating of p53 protein 1 (687-695)
accacagagcagauccccagcccugug

SEQ ID NO: 76087 - RNA, 39 nt, Artificial Sequence
  Transformer-2 protein homolog beta (29-41)
accacagagagagaccugagggaaguguucagcaaguac

SEQ ID NO: 76088 - RNA, 27 nt, Artificial Sequence
  Pre-mRNA-processing-splicing factor 8 (1254-1262)
accacauucacuaagaucgugaacaaa

SEQ ID NO: 76089 - RNA, 33 nt, Artificial Sequence
  Suppressor of tumorigenicity 7 protein (228-238)
accacaaucgccgaggcugaaaagcuguucaaa

SEQ ID NO: 76090 - RNA, 27 nt, Artificial Sequence
  Lysine-specific demethylase 6B (1272-1280)
accacaaucgccaaguacgcucaguau

SEQ ID NO: 76091 - RNA, 36 nt, Artificial Sequence
  TOX high mobility group box family member 4 (142-153)
accacaaucgaccagagcgagcuguccucucaacuc

SEQ ID NO: 76092 - RNA, 33 nt, Artificial Sequence
  Nucleolar protein 10 (56-66)
accacaaucaaggugagcaaagacggccaguac

SEQ ID NO: 76093 - RNA, 39 nt, Artificial Sequence
  V-type proton ATPase subunit F (43-55)
accacaaucaacgagauugaagacacuuucagacaguuu

SEQ ID NO: 76094 - RNA, 30 nt, Artificial Sequence
  Large neutral amino acids transporter small subunit 1 (108-117)
accacaaucagcaaguccggcggggacuac

SEQ ID NO: 76095 - RNA, 27 nt, Artificial Sequence
  WD repeat-containing protein 3 (883-891)
accacaaucagcaaggugucccagguc

SEQ ID NO: 76096 - RNA, 27 nt, Artificial Sequence
  Succinyl-CoA ligase (ADP/GDP-forming) subunit alpha, mitochondrial (321-329)
accacaaucuacaaggaguucgaaaaa

SEQ ID NO: 76097 - RNA, 27 nt, Artificial Sequence
  Neurofilament light polypeptide (267-275)
accacaaagagcgagauggccagauac

SEQ ID NO: 76098 - RNA, 30 nt, Artificial Sequence
  Melanoma-associated antigen D1 (152-161)
accacaaaggugggccccaacgccacuuac

SEQ ID NO: 76099 - RNA, 33 nt, Artificial Sequence
  Glycosylphosphatidylinositol anchor attachment 1 protein (526-536)
accacaauggugcccacugccgcucuggcaaag

SEQ ID NO: 76100 - RNA, 27 nt, Artificial Sequence
  Urocortin-2 (100-108)
accacaaacgccagaauccuggcuagg

SEQ ID NO: 76101 - RNA, 27 nt, Artificial Sequence
  Reticulon-1 (204-212)
accacacccgugaagaucacucugacg

SEQ ID NO: 76102 - RNA, 33 nt, Artificial Sequence
  Probable E3 ubiquitin-protein ligase HERC1 (3302-3312)
accacaguggacgauagcauccagagaaaguuc

SEQ ID NO: 76103 - RNA, 36 nt, Artificial Sequence
  Ubiquitin carboxyl-terminal hydrolase 19 (1362-1373)
accacaguggacgagagccaggucguuacuagauac

SEQ ID NO: 76104 - RNA, 30 nt, Artificial Sequence
  40S ribosomal protein S6 (125-134)
accacagugcccagaaggcugggcccuaag

SEQ ID NO: 76105 - RNA, 27 nt, Artificial Sequence
  Aminoacyl tRNA synthase complex-interacting multifunctional protein 2 (206-214)
accguggccgacgucguucuguggagc

SEQ ID NO: 76106 - RNA, 30 nt, Artificial Sequence
  Aminoacyl tRNA synthase complex-interacting multifunctional protein 2 (206-215)
accguggccgacgucguucuguggagcgug

SEQ ID NO: 76107 - RNA, 30 nt, Artificial Sequence; identical to SEQ ID NO: 51880
  Protein FAM73B (18-27)

SEQ ID NO: 76108 - RNA, 30 nt, Artificial Sequence
  Carboxypeptidase Q (271-280)
accguggccgagaucacaggcagcaaguac

SEQ ID NO: 76109 - RNA, 27 nt, Artificial Sequence
  Dynein heavy chain 14, axonemal (3163-3171)
accguggccgagaagcagcugcucgcu

SEQ ID NO: 76110 - RNA, 27 nt, Artificial Sequence
  Protein phosphatase 1K, mitochondrial (191-199)
accguggcccugcucagagacggcauc

SEQ ID NO: 76111 - RNA, 27 nt, Artificial Sequence
  Abl interactor 2 (96-104)
accguggacauccacaaggagaaaguc

SEQ ID NO: 76112 - RNA, 27 nt, Artificial Sequence
  Volume-regulated anion channel subunit LRRC8B (622-630)
accguggaggaaaucauuagcuuccag

SEQ ID NO: 76113 - RNA, 33 nt, Artificial Sequence
  Vimentin (446-456)
accguggagacaagagacggccaggucaucaac

SEQ ID NO: 76114 - RNA, 27 nt, Artificial Sequence
  Olfactory receptor 51G2 (211-219)
accgugggcaucgacagccugcucauu

SEQ ID NO: 76115 - RNA, 36 nt, Artificial Sequence
  Exocyst complex component 7 (401-412)
accgugcacgagcugacaagcaacgccauccucuuc

SEQ ID NO: 76116 - RNA, 27 nt, Artificial Sequence
  WD repeat-containing protein 70 (364-372)
accgugcaccccaaguuccauuacaaa

SEQ ID NO: 76117 - RNA, 27 nt, Artificial Sequence
  Eukaryotic translation initiation factor 3 subunit C-like protein (818-826)
accgugcacagcaucauuuccaagaug

SEQ ID NO: 76118 - RNA, 30 nt, Artificial Sequence
  Transmembrane emp24 domain-containing protein 3 (153-162)
accgugaucgacagccagacacacuacaga

SEQ ID NO: 76119 - RNA, 30 nt, Artificial Sequence
  60S ribosomal protein L7-like 1 (171-180)
accgugaucgaggaacaccugggcaaguuc

SEQ ID NO: 76120 - RNA, 27 nt, Artificial Sequence
  Ubiquitin carboxyl-terminal hydrolase 24 (488-496)
accgugaucgagaacauucacacaaua

SEQ ID NO: 76121 - RNA, 27 nt, Artificial Sequence
  Integrin alpha-2 (988-996)
accgugaucauucacauaccccaguac

SEQ ID NO: 76122 - RNA, 33 nt, Artificial Sequence
  Actin filament-associated protein 1-like 1 (208-218)
accgugaucagagaggaccagcugcucugcuac

SEQ ID NO: 76123 - RNA, 33 nt, Artificial Sequence
  Angiomotin (709-719)
accgugaucagccacucccccaacacaucuuac

SEQ ID NO: 76124 - RNA, 39 nt, Artificial Sequence
  Interferon-induced protein 44 (52-64)
accgugaucuacagcgaggaccacauuauaggcgccuau

SEQ ID NO: 76125 - RNA, 27 nt, Artificial Sequence
  Structural maintenance of chromosomes flexible hinge domain-containing protein 1 (90-98)
accgugaaggacggcgucacacuguac

SEQ ID NO: 76126 - RNA, 27 nt, Artificial Sequence
  Microtubule-actin cross-linking factor 1 isoform X31 (4329-4337)
accgugaaggaccagcugaacgagaug

SEQ ID NO: 76127 - RNA, 27 nt, Artificial Sequence
  DnaJ homolog subfamily B member 1 (332-340)
accgugcuggagcagguccuccccauc

SEQ ID NO: 76128 - RNA, 27 nt, Artificial Sequence
  Prostaglandin E2 receptor EP4 subtype (335-343)
accgugcugagcaaggccaucgagaaa

SEQ ID NO: 76129 - RNA, 30 nt, Artificial Sequence; identical to SEQ ID NO: 51902
  Carboxypeptidase Q (441-450)

SEQ ID NO: 76130 - RNA, 27 nt, Artificial Sequence
  Embryonic stem cell-specific 5-hydroxymethylcytosine-binding protein (101-109)
accgugauggagaagagaagcuucaaa

SEQ ID NO: 76131 - RNA, 36 nt, Artificial Sequence
  MICOS complex subunit MIC13 (90-101)
accgugaugagcgcccuguccgucgcucccucuaag

SEQ ID NO: 76132 - RNA, 27 nt, Artificial Sequence
  Zinc finger protein 3 (182-190)
accgugaacagcaaucugaucucccac

SEQ ID NO: 76133 - RNA, 27 nt, Artificial Sequence
  Mucin-3A isoform (865-873)
accgugcagaacacagagaucagcauu

SEQ ID NO: 76134 - RNA, 33 nt, Artificial Sequence
  Zinc finger BED domain-containing protein 4 (806-816)
accgugacagacaacgccagcaucggcaagacu

SEQ ID NO: 76135 - RNA, 36 nt, Artificial Sequence
  Transmembrane protein 186 (82-93)
accguggucgcccugcccccuggcuacuaucucuac

SEQ ID NO: 76136 - RNA, 27 nt, Artificial Sequence
  RNA-binding protein Musashi homolog 2 (17-25)
accguggucgaggacguuaagcaguac

SEQ ID NO: 76137 - RNA, 36 nt, Artificial Sequence
  Serine/threonine-protein kinase A-Raf (31-42)
accguggucacaguuagagacggcaugagcguguac

SEQ ID NO: 76138 - RNA, 27 nt, Artificial Sequence
  Putative oxidoreductase GLYR1 (235-243)
accguguggaacagaacagccgagaag

SEQ ID NO: 76139 - RNA, 39 nt, Artificial Sequence
  RNA-binding protein 26 (673-685)
accguguacaaccccgccgcucugaaggcagcccagaaa

SEQ ID NO: 76140 - RNA, 33 nt, Artificial Sequence; identical to SEQ ID NO: 51913
  Junction plakoglobin (21-31)

SEQ ID NO: 76141 - RNA, 48 nt, Artificial Sequence
  Caprin-1 (572-587)
accuaccacggcagccccgaccagucccaucaagugacagggaaccac

SEQ ID NO: 76142 - RNA, 27 nt, Artificial Sequence
  Spartin (153-161)
guggccgcucccgcaagccugucccuc

SEQ ID NO: 76143 - RNA, 30 nt, Artificial Sequence
  Phosphatidylinositol 3,4,5-trisphosphate 5-phosphatase 2 (908-917)
guggccgcucccccuccaaagaacagcuuc

SEQ ID NO: 76144 - RNA, 30 nt, Artificial Sequence
  Dolichyl-diphosphooligosaccharide-proteinosyltransferase subunit 2 (450-459)
guggccgagcccgacaacaagaaugucuac

SEQ ID NO: 76145 - RNA, 33 nt, Artificial Sequence
  Sodium/iodide cotransporter (484-494)
guggcccugagcgucaacgcuuccggccuccuu

SEQ ID NO: 76146 - RNA, 27 nt, Artificial Sequence
  Transcription elongation factor SPT5 (216-224)
guggcccccgagcacgucaagggcuac

SEQ ID NO: 76147 - RNA, 30 nt, Artificial Sequence
  DNA-dependent protein kinase catalytic subunit (2797-2806)
guggcccagagagaccccaucauugcuaag

SEQ ID NO: 76148 - RNA, 27 nt, Artificial Sequence
  Tetratricopeptide repeat protein 21B (25-33)
guggccagcgagggcaucaagagauac

SEQ ID NO: 76149 - RNA, 27 nt, Artificial Sequence
  Probable E3 ubiquitin-protein ligase HERC1 (1139-1147)
guggaccuggagagaaccaucgcccuc

SEQ ID NO: 76150 - RNA, 27 nt, Artificial Sequence
  Cytoplasmic dynein 1 heavy chain 1 (795-803)
guggaggaaagaaacaccaucagccug

SEQ ID NO: 76151 - RNA, 33 nt, Artificial Sequence
  L-dopachrome tautomerase (152-162)
guggaggaaacccccggcuggccuacaacucug

SEQ ID NO: 76152 - RNA, 27 nt, Artificial Sequence
  Glycogen phosphorylase, brain form (505-513)
guggagaagaucggcgaagaguuccug

SEQ ID NO: 76153 - RNA, 33 nt, Artificial Sequence
  Receptor-type tyrosine-protein phosphatase delta (635-645)
guggagaagcagaacggcaucauuaccgaauac

SEQ ID NO: 76154 - RNA, 24 nt, Artificial Sequence
  Phosphatidylinositol 3,4,5-trisphosphate-dependent Rac exchanger 1 protein (160-167)
guggagcugaacaagauccccacc

SEQ ID NO: 76155 - RNA, 27 nt, Artificial Sequence
  Prosaposin (299-307)
guggagcccaucaagaaacacgaaguc

SEQ ID NO: 76156 - RNA, 30 nt, Artificial Sequence
  Coiled-coil domain-containing protein 13 (514-523)
guggagagcgcccugaccagacccucccuc

SEQ ID NO: 76157 - RNA, 36 nt, Artificial Sequence
  Protein ZGRF1 (799-810)
guggaggucgaaaccgccagagagggcaagcaguac

SEQ ID NO: 76158 - RNA, 33 nt, Artificial Sequence
  Proteasome subunit alpha type-1 (104-114)
guguucgacagaccccugccugucagcaggcuc

SEQ ID NO: 76159 - RNA, 33 nt, Artificial Sequence
  ATP-dependent RNA helicase DDX3X (408-418)
gugggcagcaccuccgagaacaucacacagaag

SEQ ID NO: 76160 - RNA, 27 nt, Artificial Sequence
  Protocadherin-18 (261-269)
gugggcacccugcuccuugaccugaac

SEQ ID NO: 76161 - RNA, 30 nt, Artificial Sequence
  THO complex subunit 4 (113-122)
gugcacuacgacagaagcggcaggucccug

SEQ ID NO: 76162 - RNA, 36 nt, Artificial Sequence
  Butyrophilin subfamily 3 member A3 secreted isoform (174-185)
gugauccuggaccccgauaccgccaacgcuauucuc

SEQ ID NO: 76163 - RNA, 21 nt, Artificial Sequence
  Trafficking protein particle complex subunit 8 (106-112)
gugaucaccgccggcgacuac

SEQ ID NO: 76164 - RNA, 30 nt, Artificial Sequence
  P antigen family member 5 (46-55)
gugaucguccagcaacccaccgaggaaaag

SEQ ID NO: 76165 - RNA, 42 nt, Artificial Sequence
  Myosin-10 (20-33)
gugaucuacaaccccgccacccaggcugacuggacagcaaag

SEQ ID NO: 76166 - RNA, 33 nt, Artificial Sequence
  Protein-methionine sulfoxide oxidase MICAL1 (432-442)
gugcuggccgagagagaaagccucuaccagcuu

SEQ ID NO: 76167 - RNA, 30 nt, Artificial Sequence
  Protocadherin alpha-1 (636-645)
gugcuggacgaggccgaucucagcagauac

SEQ ID NO: 76168 - RNA, 27 nt, Artificial Sequence
  NF-kappa-B inhibitor epsilon (286-294)
gugcuggacauccagaacaaucucuac

SEQ ID NO: 76169 - RNA, 33 nt, Artificial Sequence
  Peroxisomal trans-2-enoyl-CoA reductase (146-156)
gugcuggagaccaaccucacaggcacuuucuac

SEQ ID NO: 76170 - RNA, 33 nt, Artificial Sequence
  Translocon-associated protein subunit alpha (19-29)
gugcuguucagaggcgggcccaggggacuccuu

SEQ ID NO: 76171 - RNA, 27 nt, Artificial Sequence
  ETS translocation variant 5 (79-87)
gugcugcacgcccccccuccaaccaag

SEQ ID NO: 76172 - RNA, 27 nt, Artificial Sequence
  Sorting nexin-14 (176-184)
gugcugaucagaaggauucacaagguc

SEQ ID NO: 76173 - RNA, 36 nt, Artificial Sequence
  Transcription initiation factor IIE subunit beta (280-291)
gugcugaaggacuacagcgauaucaccuccucuaaa

SEQ ID NO: 76174 - RNA, 33 nt, Artificial Sequence
  Adenosylhomocysteinase 2 (123-133)
gugcugcucgccgagggcagacuucugaacuug

SEQ ID NO: 76175 - RNA, 33 nt, Artificial Sequence
  Splicing factor 3B subunit 2 (163-173)
gugcugcucgagcaggaaagacaacaggagauc

SEQ ID NO: 76176 - RNA, 39 nt, Artificial Sequence
  Sodium-dependent phosphate transporter 1 (75-87)
gugcugcucggcgccaaggucagcgagaccaucagaaaa

SEQ ID NO: 76177 - RNA, 30 nt, Artificial Sequence
  HCG2043033, isoform CRA_b (11-20)
gugcugaugggccucccccuugcccaggcu

SEQ ID NO: 76178 - RNA, 30 nt, Artificial Sequence
  Armadillo repeat-containing X-linked protein 1 (210-219)
gugcugaacauccucgagagaaccaaugac

SEQ ID NO: 76179 - RNA, 27 nt, Artificial Sequence
  Protein GPR108 (359-367)
gugcugagcgacaaggagaaaaagguc

SEQ ID NO: 76180 - RNA, 30 nt, Artificial Sequence
  Leucine-rich repeat-containing protein 1 (295-304)
gugcugaccgagaaccagcuccuuacacug

SEQ ID NO: 76181 - RNA, 33 nt, Artificial Sequence
  2',3'-cyclic-nucleotide 3'-phosphodiesterase (126-136)
gugcuggucgagcccaagaccgccuggagacuc

SEQ ID NO: 76182 - RNA, 33 nt, Artificial Sequence
  Zinc finger CCHC domain-containing protein 14 (120-130)
gugcuguggagcgacuccucuaucaccucaguc

SEQ ID NO: 76183 - RNA, 30 nt, Artificial Sequence
  ADP/ATP translocase 1 (288-297)
gugcuguacgacgagaucaagaaauauguc

SEQ ID NO: 76184 - RNA, 36 nt, Artificial Sequence
  Sodium/potassium/calcium exchanger 5 (423-434)
gugcuguacgagcucggcaucauugggaacaauaag

SEQ ID NO: 76185 - RNA, 33 nt, Artificial Sequence
  Cytoplasmic dynein 1 heavy chain 1 (3839-3849)
gugcuguacgagaaccccaaucucaagggcguc

SEQ ID NO: 76186 - RNA, 45 nt, Artificial Sequence
  Dolichyl-diphosphooligosaccharide-proteinosyltransferase subunit 4 (23-37)
gugcuguaccacuaugucgccguuaacaaucccaagaaacaggag

SEQ ID NO: 76187 - RNA, 39 nt, Artificial Sequence
  Ras-related protein Rab-27A (25-37)
gugcuguaccaguauaccgacggcaaguucaacagcaaa

SEQ ID NO: 76188 - RNA, 24 nt, Artificial Sequence
  HLA class I histocompatibility antigen, A-29 alpha chain (3-10)
gugauggcccccagaacccugcuc

SEQ ID NO: 76189 - RNA, 27 nt, Artificial Sequence
  Embryonic stem cell-specific 5-hydroxymethylcytosine-binding protein (102-110)
gugauggagaagagaagcuucaaaguc

SEQ ID NO: 76190 - RNA, 33 nt, Artificial Sequence
  Ribosomal protein S6 kinase alpha-2 (56-66)
gugauguucaccgaggaagacgucaaguuuuac

SEQ ID NO: 76191 - RNA, 27 nt, Artificial Sequence
  Antigen KI-67 (115-123)
gugaugcacacccccccuguccugaag

SEQ ID NO: 76192 - RNA, 39 nt, Artificial Sequence
  Transient receptor potential cation channel subfamily V member 2 (253-265)
gugaugaucagcgacaacuccgccgagaauauugcucug

SEQ ID NO: 76193 - RNA, 27 nt, Artificial Sequence
  Signal transducer and activator of transcription 1-alpha/beta (134-142)
gugaugcuggacaagcagaaagagcuc

SEQ ID NO: 76194 - RNA, 30 nt, Artificial Sequence
  Poly(U)-binding-splicing factor PUF60 (175-184)
gugaugcugggcgggagaaacaucaagguc

SEQ ID NO: 76195 - RNA, 27 nt, Artificial Sequence
  Transcriptional coactivator YAP1 (72-80)
gugaugaaccccaagaccgccaauguc

SEQ ID NO: 76196 - RNA, 27 nt, Artificial Sequence
  CD63 antigen (111-119)
gugaugagcgaguucaacaauaacuuu

SEQ ID NO: 76197 - RNA, 30 nt, Artificial Sequence
  Ras-related C3 botulinum toxin substrate 1 (44-53)
gugauggucgacggcaagcccguuaaccug

SEQ ID NO: 76198 - RNA, 33 nt, Artificial Sequence
  Uncharacterized protein C4orf36 (5-15)
gugcccagaaagaacaccgucaaaacaauccug

SEQ ID NO: 76199 - RNA, 27 nt, Artificial Sequence
  Zinc finger protein ZFAT (1182-1190)
gugcagcaagccagcgucgagcuggcu

SEQ ID NO: 76200 - RNA, 27 nt, Artificial Sequence
  tRNA wybutosine-synthesizing protein 4 (287-295)
gugcagugggacggcagacuguaccac

SEQ ID NO: 76201 - RNA, 27 nt, Artificial Sequence
  Pre-mRNA-processing-splicing factor 8 (1168-1176)
gugcagugggagaacagcuucgucucc

SEQ ID NO: 76202 - RNA, 33 nt, Artificial Sequence
  Unconventional myosin-X (553-563)
gugcaguacgacgucagaggcauccuggagaag

SEQ ID NO: 76203 - RNA, 54 nt, Artificial Sequence
  Probable ATP-dependent RNA helicase DDX5 (550-567)
gugagcgccggcauccagaccuccuucagaacagggaaccccacuggaacguac

SEQ ID NO: 76204 - RNA, 27 nt, Artificial Sequence
  60S ribosomal protein L24 (148-156)
gugagcgcccccagagucggcgggaag

SEQ ID NO: 76205 - RNA, 27 nt, Artificial Sequence
  NADH dehydrogenase (ubiquinone) iron-sulfur protein 2, mitochondrial (8-16)
gugagcgacggcuccucuagacccuac

SEQ ID NO: 76206 - RNA, 27 nt, Artificial Sequence
  Single Ig IL-1-related receptor (387-395)
gugagcgaccugggcuccagaaacuac

SEQ ID NO: 76207 - RNA, 27 nt, Artificial Sequence
  MAM domain-containingosylphosphatidylinositol anchor protein 1 (140-148)
gugagcgacgucagaggcaacuucuac

SEQ ID NO: 76208 - RNA, 33 nt, Artificial Sequence
  Protein eva-1 homolog A (27-37)
gugagcgagaaccccgaaagagccgcucuguac

SEQ ID NO: 76209 - RNA, 27 nt, Artificial Sequence
  Clustered mitochondria protein homolog (512-520)
gugagccaccccagauaccuggagcuc

SEQ ID NO: 76210 - RNA, 27 nt, Artificial Sequence
  ER degradation-enhancing alpha-mannosidase-like protein 2 (270-278)
gugagcaugcccgucuuccagucccug

SEQ ID NO: 76211 - RNA, 33 nt, Artificial Sequence
  Transmembrane protein 50A (73-83)
gugagcaacggccaggucagaggggacuccuac

SEQ ID NO: 76212 - RNA, 36 nt, Artificial Sequence
  Natriuretic peptides A (87-98)
gugagccccgcccagagagacggcggggcucuggga

SEQ ID NO: 76213 - RNA, 27 nt, Artificial Sequence
  Pre-mRNA-processing-splicing factor 8 (2131-2139)
gugagccccccugacaacccacagguc

SEQ ID NO: 76214 - RNA, 33 nt, Artificial Sequence
  PRO2822 (92-102)
gugagccaggacggccugaaccuccuuacccug

SEQ ID NO: 76215 - RNA, 30 nt, Artificial Sequence
  PAB-dependent poly(A)-specific ribonuclease subunit PAN3 (183-192)
gugagccagacccccuccucuggccaaguc

SEQ ID NO: 76216 - RNA, 30 nt, Artificial Sequence
  Heat shock cognate 71 kDa protein (536-545)
gugagcuccaagaacucucuggagucauac

SEQ ID NO: 76217 - RNA, 27 nt, Artificial Sequence
  Zinc finger protein with KRAB and SCAN domains 2 (134-142)
gugagcucccccguccacagagagaag

SEQ ID NO: 76218 - RNA, 33 nt, Artificial Sequence
  Complex I assembly factor TMEM126B, mitochondrial (46-56)
gugaccgacaagcuguucgucaucgaugcccuc

SEQ ID NO: 76219 - RNA, 27 nt, Artificial Sequence
  Uncharacterized protein C11orf63 (295-303)
gugaccgacaagacaagcauccagaac

SEQ ID NO: 76220 - RNA, 27 nt, Artificial Sequence
  Receptor-type tyrosine-protein phosphatase zeta (705-713)
gugaccgaccuggagaugccccacuac

SEQ ID NO: 76221 - RNA, 24 nt, Artificial Sequence
  F-box/LRR-repeat protein 7 (316-323)
gugaccgacgucggcaucagauac

SEQ ID NO: 76222 - RNA, 33 nt, Artificial Sequence
  Heterogeneous nuclear ribonucleoprotein Q (266-276)
gugaccgagggccugacagacgucauccucuac

SEQ ID NO: 76223 - RNA, 24 nt, Artificial Sequence
  Filamin-A (2353-2360)
gugaccgagaucgaccaggauaag

SEQ ID NO: 76224 - RNA, 30 nt, Artificial Sequence
  1-acyl-sn-glycerol-3-phosphate acyltransferase gamma (296-305)
gugaccgagaucgaaaagggcagcuccuac

SEQ ID NO: 76225 - RNA, 30 nt, Artificial Sequence
  Carbonic anhydrase-related protein (181-190)
gugaccgagauccugcaggacauucaauac

SEQ ID NO: 76226 - RNA, 30 nt, Artificial Sequence
  Short-chain-specific acyl-CoA dehydrogenase, mitochondrial (369-378)
gugaccgagaugcccgccgaaagacacuac

SEQ ID NO: 76227 - RNA, 27 nt, Artificial Sequence
  Tyrosine-protein kinase TXK (10-18)
gugaccgagaacaagaucacaaaucug

SEQ ID NO: 76228 - RNA, 21 nt, Artificial Sequence
  Integrin beta-3 (336-342)
gugaccgagaacgucguuaau

SEQ ID NO: 76229 - RNA, 27 nt, Artificial Sequence
  Integrin beta-3 (336-344)
gugaccgagaacgucguuaaucuguac

SEQ ID NO: 76230 - RNA, 36 nt, Artificial Sequence
  Integrin beta-3 (336-347)
gugaccgagaacgucguuaaucuguaccagaacuau

SEQ ID NO: 76231 - RNA, 30 nt, Artificial Sequence
  Myosin phosphatase Rho-interacting protein (65-74)
gugaccgaguaccccguccagagaaacuau

SEQ ID NO: 76232 - RNA, 27 nt, Artificial Sequence
  Lymphocyte antigen 6E (61-69)
gugaccuucggccacagccuguccaag

SEQ ID NO: 76233 - RNA, 27 nt, Artificial Sequence
  OX-2 membraneoprotein (76-84)
gugaccuucagcgagaaccacggcguc

SEQ ID NO: 76234 - RNA, 30 nt, Artificial Sequence; identical to SEQ ID NO: 52007
  Annexin A9 (3-12)

SEQ ID NO: 76235 - RNA, 30 nt, Artificial Sequence
  Zinc finger FYVE domain-containing protein 16 (97-106)
gugaccggccuggaccuccuuagcuccguc

SEQ ID NO: 76236 - RNA, 33 nt, Artificial Sequence
  Kinesin-like protein KIF6 (24-34)
gugaccaucgacgauaacaagcagauucugaaa

SEQ ID NO: 76237 - RNA, 27 nt, Artificial Sequence
  RNA pseudouridylate synthase domain-containing protein 1 (112-120)
gugaccaucagccacgccauuggcaga

SEQ ID NO: 76238 - RNA, 27 nt, Artificial Sequence
  Endoribonuclease Dicer (827-835)
gugaccaucagcauugagcugaagaaa

SEQ ID NO: 76239 - RNA, 33 nt, Artificial Sequence
  FACT complex subunit SPT16 (3-13)
gugacccuggacaaggaugccuacuauagaagg

SEQ ID NO: 76240 - RNA, 27 nt, Artificial Sequence
  Pappalysin-1 (689-697)
gugacccuggagugguuccccccuauc

SEQ ID NO: 76241 - RNA, 30 nt, Artificial Sequence
  Autophagy-related protein 9A (411-420)
gugacccugcucggcgucacaguuacugug

SEQ ID NO: 76242 - RNA, 30 nt, Artificial Sequence
  WD repeat-containing protein 70 (23-32)
gugaccaugggcuucacaggguuuggaaag

SEQ ID NO: 76243 - RNA, 33 nt, Artificial Sequence
  Small subunit processome component 20 homolog (830-840)
gugaccaaccccgacaucgccgcuaagaaaaag

SEQ ID NO: 76244 - RNA, 27 nt, Artificial Sequence
  DNA (cytosine-5)-methyltransferase 1 (1422-1430)
gugaccaaccccgagccuaugggcaag

SEQ ID NO: 76245 - RNA, 27 nt, Artificial Sequence
  Beta-parvin (138-146)
gugacccagagcgagaucggccaaaag

SEQ ID NO: 76246 - RNA, 27 nt, Artificial Sequence
  Polymerase delta-interacting protein 3 (410-418)
gugaccacacagcccacugaguucaag

SEQ ID NO: 76247 - RNA, 30 nt, Artificial Sequence
  Polycystin-1 (1443-1452)
gugaccgucacagccagcaacaauaucucc

SEQ ID NO: 76248 - RNA, 27 nt, Artificial Sequence
  LisH domain-containing protein ARMC9 (225-233)
gugaccuaccugaagagauauaacaaa

SEQ ID NO: 76249 - RNA, 33 nt, Artificial Sequence
  Trafficking protein particle complex subunit 2-like protein (8-18)
guggucgacgagaagaucagcgccaugggcaaa

SEQ ID NO: 76250 - RNA, 30 nt, Artificial Sequence; identical to SEQ ID NO: 52023
  Beta-actin-like protein 2 (10-19)

SEQ ID NO: 76251 - RNA, 36 nt, Artificial Sequence
  Beta-actin-like protein 2 (10-21)
guggucgacaacggcagcgggaugugcaaggccgga

SEQ ID NO: 76252 - RNA, 27 nt, Artificial Sequence
  Cytosolic acyl coenzyme A thioester hydrolase (273-281)
guggucgacagcucccagaagagauac

SEQ ID NO: 76253 - RNA, 30 nt, Artificial Sequence
  Catalase (55-64)
guggucuucaccgacgagauggcccacuuu

SEQ ID NO: 76254 - RNA, 33 nt, Artificial Sequence
  RAB6A-GEF complex partner protein 2 (239-249)
guggucggcacccugaaccucggggagggaaca

SEQ ID NO: 76255 - RNA, 33 nt, Artificial Sequence
  Retroviral-like aspartic protease 1 (242-252)
guggucaagguugccaacggcgcugagaugaaa

SEQ ID NO: 76256 - RNA, 33 nt, Artificial Sequence; identical to SEQ ID NO: 52029
  Thiosulfate sulfurtransferase (97-107)

SEQ ID NO: 76257 - RNA, 27 nt, Artificial Sequence
  Keratinocyte-associated transmembrane protein 2 (212-220)
guggucuacaucaccuaucacaacaag

SEQ ID NO: 76258 - RNA, 39 nt, Artificial Sequence
  HLA class I histocompatibility antigen, B-40 alpha chain (243-255)
ugggccgcuguggucguucccagcggcgaggaacagaga

SEQ ID NO: 76259 - RNA, 27 nt, Artificial Sequence
  Glycerol kinase (156-164)
uggcugcucgacaacgugagaaagguc

SEQ ID NO: 76260 - RNA, 33 nt, Artificial Sequence
  Protein transport protein Sec61 subunit alpha isoform 1 (324-334)
uggagcgacaccuccucuggcgggcccgccaga

SEQ ID NO: 76261 - RNA, 30 nt, Artificial Sequence
  Ubiquitin carboxyl-terminal hydrolase 48 (533-542)
uacgccgcugacaucuucuauagcagauac

SEQ ID NO: 76262 - RNA, 27 nt, Artificial Sequence
  RNA-binding protein 14 (528-536)
uacgccgcucagcaacacccccaggca

SEQ ID NO: 76263 - RNA, 33 nt, Artificial Sequence
  Unconventional myosin-Va (62-72)
uacgccgacgaucccaagaaauaucagagcuac

SEQ ID NO: 76264 - RNA, 30 nt, Artificial Sequence
  V-type proton ATPase subunit B, kidney isoform (384-393)
uacgccaucggcaaggacgugcaggcuaug

SEQ ID NO: 76265 - RNA, 27 nt, Artificial Sequence
  Junction plakoglobin (245-253)
uacgccaucaccacacugcacaaccuc

SEQ ID NO: 76266 - RNA, 27 nt, Artificial Sequence
  Threonine-tRNA ligase, mitochondrial (546-554)
uacgccaaggaggcucagcaaagccug

SEQ ID NO: 76267 - RNA, 27 nt, Artificial Sequence
  G2/mitotic-specific cyclin-B2 (368-376)
uacgccagcuccaagcugcucaaaauc

SEQ ID NO: 76268 - RNA, 27 nt, Artificial Sequence
  Heterogeneous nuclear ribonucleoprotein L (430-438)
uacgccguggacagagcuaucacccac

SEQ ID NO: 76269 - RNA, 33 nt, Artificial Sequence
  Protein-methionine sulfoxide oxidase MICAL3 (803-813)
uacgccuaugacaucgaggauggcaaguucuac

SEQ ID NO: 76270 - RNA, 27 nt, Artificial Sequence
  Hypoxia-inducible factor 1-alpha (254-262)
uacugcgacgagagaaucaccgaacug

SEQ ID NO: 76271 - RNA, 27 nt, Artificial Sequence
  Zinc finger protein 362 (287-295)
uacugcgacaagagcuucagacagcug

SEQ ID NO: 76272 - RNA, 39 nt, Artificial Sequence
  Cofilin-1 (85-97)
uacgacgccaccuaugagacaaaggaaagcaaaaaggag

SEQ ID NO: 76273 - RNA, 30 nt, Artificial Sequence
  Melanoma antigen preferentially expressed in tumors (448-457)
uacgaggacauccacggcacccugcaucuc

SEQ ID NO: 76274 - RNA, 27 nt, Artificial Sequence
  Transmembrane protein 9B (93-101)
uacgaggaaagaagcuccgugaccauc

SEQ ID NO: 76275 - RNA, 33 nt, Artificial Sequence
  Ubiquitin-like protein 5 (60-70)
uacgagauccacgacggcaugaaccuggaacuc

SEQ ID NO: 76276 - RNA, 36 nt, Artificial Sequence
  HLA class I histocompatibility antigen, alpha chain E (124-135)
uacgagcaguucgccuaugacggcaaggauuaccug

SEQ ID NO: 76277 - RNA, 27 nt, Artificial Sequence
  Carbohydrate sulfotransferase 14 (199-207)
uacggcgccgagaucgugagaagguau

SEQ ID NO: 76278 - RNA, 27 nt, Artificial Sequence
  RNA-binding protein 14 (474-482)
uacggcgcccaggcuagcauggggcug

SEQ ID NO: 76279 - RNA, 33 nt, Artificial Sequence
  Transcription factor SOX-10 (412-422)
uacggccacagcgggcaggccuccggacuguau

SEQ ID NO: 76280 - RNA, 36 nt, Artificial Sequence
  Heterogeneous nuclear ribonucleoproteins A2/B1 (243-254)
uacggcagcgggaacuauaaugacuucggaaacuac

SEQ ID NO: 76281 - RNA, 30 nt, Artificial Sequence
  RNMT-activating mini protein (107-116)
uacggcuauaaccagagacccccuuacggg

SEQ ID NO: 76282 - RNA, 30 nt, Artificial Sequence
  Histone deacetylase complex subunit SAP130 (880-889)
uacaucgacgaggaaggcgugagauauguc

SEQ ID NO: 76283 - RNA, 33 nt, Artificial Sequence
  Cleft lip and palate transmembrane protein 1 (409-419)
uacauccuggacaacgagaccaauuucgugguc

SEQ ID NO: 76284 - RNA, 33 nt, Artificial Sequence
  Negative elongation factor C/D (47-57)
uacaucauggagcccagcauuuucaacacccug

SEQ ID NO: 76285 - RNA, 27 nt, Artificial Sequence
  Filamin-B (1580-1588)
uacauccccgacaagaccggcagauau

SEQ ID NO: 76286 - RNA, 27 nt, Artificial Sequence
  Beta-catenin-interacting protein 1 (15-23)
uacauccagcaaaaggugagaguccug

SEQ ID NO: 76287 - RNA, 30 nt, Artificial Sequence
  Signal recognition particle 9 kDa protein (18-27)
uaccuggccgaccccaugaaggcuagagug

SEQ ID NO: 76288 - RNA, 27 nt, Artificial Sequence
  S-phase kinase-associated protein 1 (33-41)
uaccuggacaucaagggccuccuugau

SEQ ID NO: 76289 - RNA, 30 nt, Artificial Sequence
  Procollagen-lysine,2-oxoglutarate 5-dioxygenase 3 (199-208)
uaccuggaccccggccucagagagaagcuu

SEQ ID NO: 76290 - RNA, 30 nt, Artificial Sequence; identical to SEQ ID NO: 52063
  Protein dpy-30 homolog (56-65)

SEQ ID NO: 76291 - RNA, 33 nt, Artificial Sequence
  Lysyl oxidase homolog 4 (547-557)
uaccuggaggacagaccccucagccagcuuuau

SEQ ID NO: 76292 - RNA, 36 nt, Artificial Sequence
  Ectonucleotide pyrophosphatase/phosphodiesterase family member 1 (319-330)
uaccuggaggaacccgacagcuccggccacucuuau

SEQ ID NO: 76293 - RNA, 27 nt, Artificial Sequence
  HLA class I histocompatibility antigen, Cw-8 alpha chain (170-178)
uaccuggagaacggcaagaaaacccuc

SEQ ID NO: 76294 - RNA, 33 nt, Artificial Sequence
  Prolyl endopeptidase (353-363)
uaccugcacgacgugaagaacauccuccagcuu

SEQ ID NO: 76295 - RNA, 33 nt, Artificial Sequence
  Unconventional myosin-Vb (79-89)
uaccugcacgagcccgccgugcuccauaaccuu

SEQ ID NO: 76296 - RNA, 33 nt, Artificial Sequence
  Dystonin (981-991)
uaccugaucaacgagauugacagaauaagggcc

SEQ ID NO: 76297 - RNA, 33 nt, Artificial Sequence
  Tubulin polyglutamylase TTLL5 (191-201)
uaccugaucaacaaucccaaccagauuagccuc

SEQ ID NO: 76298 - RNA, 36 nt, Artificial Sequence
  Vacuolar protein sorting-associated protein 13C (2639-2650)
uaccugcucgagggcaccgccgaaacacacgagcuu

SEQ ID NO: 76299 - RNA, 27 nt, Artificial Sequence
  Unconventional myosin-XIX (218-226)
uaccugcucgagaagaccagaguggcc

SEQ ID NO: 76300 - RNA, 30 nt, Artificial Sequence
  Transforming growth factor-beta receptor-associated protein 1 (431-440)
uaccugaacgaggugagaagcaccgaaguc

SEQ ID NO: 76301 - RNA, 33 nt, Artificial Sequence
  CD302 antigen (163-173)
uaccugagcgacaaccacauccucauuuccgcc

SEQ ID NO: 76302 - RNA, 33 nt, Artificial Sequence
  GPI inositol-deacylase (41-51)
uacauguucgaguaucccgaauaccagaagauc

SEQ ID NO: 76303 - RNA, 33 nt, Artificial Sequence
  Methyl-CpG-binding domain protein 4 (530-540)
uaccccaucgagcugcacggcauugggaaguau

SEQ ID NO: 76304 - RNA, 27 nt, Artificial Sequence
  TRIO and F-actin-binding protein (394-402)
uaccaggaggaacugagcagagagcuc

SEQ ID NO: 76305 - RNA, 27 nt, Artificial Sequence
  ATP synthase-coupling factor 6, mitochondrial (75-83)
uaccagcaagagcuggaaagagagcuc

SEQ ID NO: 76306 - RNA, 33 nt, Artificial Sequence
  Caprin-1 (665-675)
uaccagagagacggcuaucaacagaacuucaag

SEQ ID NO: 76307 - RNA, 30 nt, Artificial Sequence
  Melanocyte protein PMEL (485-494)
uacagauauggcagcuucuccgugacccug

SEQ ID NO: 76308 - RNA, 30 nt, Artificial Sequence
  PDZ and LIM domain protein 2 (315-324)
uacagcgcccccgcuacccuguccucuaga

SEQ ID NO: 76309 - RNA, 45 nt, Artificial Sequence
  Interleukin enhancer-binding factor 3 (690-704)
uacagcgacuucuuuaccgauugcuauggcuaccacgacuucggg

SEQ ID NO: 76310 - RNA, 27 nt, Artificial Sequence
  Sphingosine-1-phosphate lyase 1 (366-374)
uacagcgacaagaaauauagaaacuac

SEQ ID NO: 76311 - RNA, 51 nt, Artificial Sequence
  Cold-inducible RNA-binding protein (151-167)
uacagcgacagauccucuggcgggucauauagggauaguuacgacagcuau

SEQ ID NO: 76312 - RNA, 30 nt, Artificial Sequence
  AF4/FMR2 family member 2 (1092-1101)
uacagcgagaccguggaacugcucagauau

SEQ ID NO: 76313 - RNA, 45 nt, Artificial Sequence
  Ribonucleoprotein PTB-binding 1 (601-615)
uacagcuucgacuaucccuccgauaugggcccuagaaggcuguuu

SEQ ID NO: 76314 - RNA, 45 nt, Artificial Sequence
  Heterogeneous nuclear ribonucleoprotein A1 (260-274)
uacagcggcggguccagaggauaugguucuggcgggcagggauac

SEQ ID NO: 76315 - RNA, 39 nt, Artificial Sequence
  Interleukin enhancer-binding factor 3 (624-636)
uacagcggcuccgggggaagaucugguggcaacucauau

SEQ ID NO: 76316 - RNA, 39 nt, Artificial Sequence
  Heterogeneous nuclear ribonucleoprotein D-like (222-234)
uacagcggcuaugggggauacgacuauaccgguuacaac

SEQ ID NO: 76317 - RNA, 42 nt, Artificial Sequence
  Heterogeneous nuclear ribonucleoprotein D-like (222-235)
uacagcggcuaugggggauacgacuauaccgguuacaacuau

SEQ ID NO: 76318 - RNA, 42 nt, Artificial Sequence
  Caprin-1 (662-675)
uacagcggcuaucagagagacggguaccaacagaacuucaag

SEQ ID NO: 76319 - RNA, 24 nt, Artificial Sequence
  Transmembrane protein 214 (171-178)
uacagccugguguccagagagcuc

SEQ ID NO: 76320 - RNA, 57 nt, Artificial Sequence
  Cold-inducible RNA-binding protein (142-160)
uacagcuccagaucucagucaggcggguauagugacaggagcuccggagguucuuac

SEQ ID NO: 76321 - RNA, 27 nt, Artificial Sequence
  Condensin complex subunit 2 (428-436)
uacagcuauuucucccccagaaccaug

SEQ ID NO: 76322 - RNA, 24 nt, Artificial Sequence
  CBP80/20-dependent translation initiation factor (506-513)
uacaccugccugagagagcuccuu

SEQ ID NO: 76323 - RNA, 36 nt, Artificial Sequence
  Transcription factor SOX-10 (369-380)
uacaccgaccagcccagcacaucccaaaucgccuau

SEQ ID NO: 76324 - RNA, 42 nt, Artificial Sequence
  Sialidase-1 (400-413)
uacaccgagagcaucuccguggccaagauuucugucuauggc

SEQ ID NO: 76325 - RNA, 27 nt, Artificial Sequence
  Metalloproteinase inhibitor 3 (48-56)
uacaccaucaagcagaugaaaauguau

SEQ ID NO: 76326 - RNA, 27 nt, Artificial Sequence
  Nodal modulator 2 (59-67)
uacaccaagcacggcacacugaaauau

SEQ ID NO: 76327 - RNA, 36 nt, Artificial Sequence
  Cyclin-dependent kinase 1 (4-15)
uacaccaagaucgagaaaauuggcgaagggacauau

SEQ ID NO: 76328 - RNA, 33 nt, Artificial Sequence
  Syndecan-3 (347-357)
uacacccuggaggaacccaagcaggccagcgug

SEQ ID NO: 76329 - RNA, 27 nt, Artificial Sequence
  Nuclear receptor ROR-beta (229-237)
uacaccauggaggaacugcaccagcuc

SEQ ID NO: 76330 - RNA, 45 nt, Artificial Sequence
  Caprin-1 (651-665)
uacacccagagccaauucuccgcccccagagacuauucuggcuac

SEQ ID NO: 76331 - RNA, 27 nt, Artificial Sequence
  ATP-binding cassette sub-family B member 8, mitochondrial (162-170)
uacaccagagaccacgugggcagcuuc

SEQ ID NO: 76332 - RNA, 27 nt, Artificial Sequence
  ATP-dependent 6-phosphofructokinase, platelet type (378-386)
uacaccacagacuucaucuaucagcug

SEQ ID NO: 76333 - RNA, 33 nt, Artificial Sequence
  Sulfhydryl oxidase 2 (323-333)
uacaccguggaccuggagagcggccuccacuau

SEQ ID NO: 76334 - RNA, 27 nt, Artificial Sequence
  ER degradation-enhancing alpha-mannosidase-like protein 2 (322-330)
uacaccguggagaagagagaaggcuau

SEQ ID NO: 76335 - RNA, 33 nt, Artificial Sequence
  Membrane-associated transporter protein (439-449)
uacaccgugcccuucaaccugaucacagaguau

SEQ ID NO: 76336 - RNA, 27 nt, Artificial Sequence
  Dolichyl-diphosphooligosaccharide-proteinosyltransferase 48 kDa subunit (325-333)
uacaccgugacagaccuggucgaguau

SEQ ID NO: 76337 - RNA, 36 nt, Artificial Sequence
  Sulfhydryl oxidase 1 (728-739)
uacaccuauuuccaggccaagaucagagcucugaaa

SEQ ID NO: 76338 - RNA, 30 nt, Artificial Sequence
  Eukaryotic translation initiation factor 3 subunit E (286-295)
uacaccuauaaggaccccaucacagaguuc

SEQ ID NO: 76339 - RNA, 33 nt, Artificial Sequence
  ATP-binding cassette sub-family A member 7 (1610-1620)
uacguggcccccgcuaaccugccugcacuccuu

SEQ ID NO: 76340 - RNA, 33 nt, Artificial Sequence
  General transcription factor 3C polypeptide 1 (627-637)
uacguggacgaugccagcuggaugagauauauc

SEQ ID NO: 76341 - RNA, 27 nt, Artificial Sequence
  Spectrin alpha chain, non-erythrocytic 1 (2453-2461)
uacguggacggcaaggggagagagcug

SEQ ID NO: 76342 - RNA, 33 nt, Artificial Sequence
  Tribbles homolog 1 (157-167)
uacguguucuuugagaaggacuucggcgauaug

SEQ ID NO: 76343 - RNA, 27 nt, Artificial Sequence
  Kelch domain-containing protein 10 (220-228)
uacguguucggcgggaccacaggauau

SEQ ID NO: 76344 - RNA, 30 nt, Artificial Sequence
  Actin, aortic smooth muscle (55-64)
uacgugggcgacgaggcccagagcaagaga

SEQ ID NO: 76345 - RNA, 33 nt, Artificial Sequence
  Actin, aortic smooth muscle (55-65)
uacgugggcgacgaggcccagagcaagagaggg

SEQ ID NO: 76346 - RNA, 33 nt, Artificial Sequence
  E3 ubiquitin-protein ligase HUWE1 (1115-1125)
uacgugggcaucgccacccugauugcuaacuau

SEQ ID NO: 76347 - RNA, 30 nt, Artificial Sequence
  Ankyrin repeat and SAM domain-containing protein 1A (113-122)
uacgugcacagcuuccuguccucuggcuau

SEQ ID NO: 76348 - RNA, 36 nt, Artificial Sequence
  Cytospin-A (477-488)
uacgugaucgacgaggaugucaagagcggcagauau

SEQ ID NO: 76349 - RNA, 39 nt, Artificial Sequence
  Cytospin-A (477-489)
uacgugaucgacgaggaugucaagagcggcagauauaug

SEQ ID NO: 76350 - RNA, 27 nt, Artificial Sequence
  Kelch-like protein 42 (328-336)
uacgugaucggcggguauaccacaaga

SEQ ID NO: 76351 - RNA, 27 nt, Artificial Sequence
  Lysosome-associated membraneoprotein 2 (396-404)
uacgugaucggcagaaggaagagcuau

SEQ ID NO: 76352 - RNA, 36 nt, Artificial Sequence
  Lysosome-associated membraneoprotein 2 (396-407)
uacgugaucggcagaaggaagagcuaugccggguac

SEQ ID NO: 76353 - RNA, 33 nt, Artificial Sequence
  Tyrosinase (149-159)
uacgugauccccauuggcaccuaugggcagaug

SEQ ID NO: 76354 - RNA, 30 nt, Artificial Sequence
  Partner of Y14 and mago (5-14)
uacgugaccgacgagacaggcgggaaguau

SEQ ID NO: 76355 - RNA, 36 nt, Artificial Sequence
  Solute carrier family 25 member 33 (176-187)
uacguguaucagaccgagggcaucagaggguucuac

SEQ ID NO: 76356 - RNA, 30 nt, Artificial Sequence
  Plexin-A1 (224-233)
uacguguauagcuucagauccgagcaguuu

SEQ ID NO: 76357 - RNA, 27 nt, Artificial Sequence
  L-dopachrome tautomerase (190-198)
uacuauagcgugagagacacccugcuc

SEQ ID NO: 76358 - RNA, 30 nt, Artificial Sequence
  GTPase Kras (52-61) mod
cugcucgacauccuugauaccgccggccug

SEQ ID NO: 76359 - RNA, 27 nt, Artificial Sequence
  GTPase Kras (5-13) mod
aagcugguggucguuggcgccggggug

SEQ ID NO: 76360 - RNA, 30 nt, Artificial Sequence
  GTPase Kras (5-14) mod
aagcugguggucguuggcgccgcuggggug

SEQ ID NO: 76361 - RNA, 33 nt, Artificial Sequence
  GTPase Kras (51-61) mod
ugccugcucgacauccuugauaccgccggccug

SEQ ID NO: 76362 - RNA, 27 nt, Artificial Sequence
  GTPase Kras (51-59)
ugccugcucgacauccuugauaccgcc

SEQ ID NO: 76363 - RNA, 27 nt, Artificial Sequence
  GTPase Kras (5-13) mod
aagcugguggucguuggcgccugcgug

SEQ ID NO: 76364 - RNA, 30 nt, Artificial Sequence
  GTPase Kras (5-14)
aagcugguggucguuggcgccgggggagug

SEQ ID NO: 76365 - RNA, 30 nt, Artificial Sequence
  GTPase Kras (5-14) mod
aagcugguggucguuggcgccagcggggug

SEQ ID NO: 76366 - RNA, 30 nt, Artificial Sequence
  GTPase Kras (5-14) mod
aagcugguggucguuggcgccgacggggug

SEQ ID NO: 76367 - RNA, 30 nt, Artificial Sequence
  GTPase Kras (5-14) mod
aagcugguggucguuggcgccugcggggug

SEQ ID NO: 76368 - RNA, 27 nt, Artificial Sequence
  GTPase Kras (1-9)
augaccgaguacaagcugguggucguu

SEQ ID NO: 76369 - RNA, 30 nt, Artificial Sequence
  GTPase Kras (5-14) mod
aagcugguggucguuggcgccgugggggua

SEQ ID NO: 76370 - RNA, 96 nt, Artificial Sequence
  GTPase Kras (1-33) mod
augaccgaguacaagcugguggucguuggcgccgcuggggugggaaaaagcgcacucacaauccagcuuauucaaaaccacuucguagacgaauau

SEQ ID NO: 76371 - RNA, 96 nt, Artificial Sequence
  GTPase Kras (1-33) mod
augaccgaguacaagcugguggucguuggcgccagcggggugggaaaauccgcucucacaauccagcuuauucaaaaccacuucguagacgaauau

SEQ ID NO: 76372 - RNA, 96 nt, Artificial Sequence
  GTPase Kras (1-33) mod
augaccgaguacaagcugguggucguuggcgccggggacgugggaaaaagcgcucucacaauccagcuuauucaaaaccacuucguagaugaauau

SEQ ID NO: 76373 - RNA, 75 nt, Artificial Sequence
  GTPase Kras (1-26) mod
augaccgaguacaaccugguggucguuggcgccgggggaguggguaagagcgcucucacaauccagcuuauucaa

SEQ ID NO: 76374 - RNA, 123 nt, Artificial Sequence
  GTPase Kras mod (3-43)
agcuacagaaagcagguggucaucgacggcgagaccugccugcucgauauucuugacacaacugggcaagaagaguauuccgccaugagggaucaguacaugcggacgggagaagguuuccug

SEQ ID NO: 76375 - RNA, 27 nt, Artificial Sequence
  BRAF (597-605) V600E
cuggccaccgagaagagcagauggucc

SEQ ID NO: 76376 - RNA, 30 nt, Artificial Sequence
  BRAF (597-606) V600E
cuggccaccgagaagagcagaugguccggc

SEQ ID NO: 76377 - RNA, 30 nt, Artificial Sequence
  BRAF(597-606) V600M
cuggccaccaugaagagcagaugguccggc

SEQ ID NO: 76378 - RNA, 27 nt, Artificial Sequence
  p53 wt (65-73)
agaaugcccgaggccgcuccuccagug

SEQ ID NO: 76379 - RNA, 27 nt, Artificial Sequence
  p53 wt (149-157)
agcacccccccuccaggcacaagagug

SEQ ID NO: 76380 - RNA, 33 nt, Artificial Sequence; identical to SEQ ID NO: 52233
  p53 wt (187-197)

SEQ ID NO: 76381 - RNA, 27 nt, Artificial Sequence
  p53 wt (217-225)
gugguccccuacgagccuccagaaguu

SEQ ID NO: 76382 - RNA, 27 nt, Artificial Sequence
  p53 wt (264-272)
cugcucggcagaaacagcuucgaggug

SEQ ID NO: 76383 - RNA, 27 nt, Artificial Sequence
  p53 wt (125134)
accuaccccgcccugaacaagauguuc

SEQ ID NO: 76384 - RNA, 27 nt, Artificial Sequence
  p53 wt (161169)
gccaucuacaagcagagccaacacaug

SEQ ID NO: 76385 - RNA, 27 nt, Artificial Sequence
  p53 wt (204212)
gaguaccuggacgauagaaacaccuuc

SEQ ID NO: 76386 - RNA, 42 nt, Artificial Sequence
  p53 wt (108-122)
ggcuucagacugggguuucuccacagcggaaccgccuccgug

SEQ ID NO: 76387 - RNA, 42 nt, Artificial Sequence
  p53 wt (110-124)
agacugggcuuccuccacagcgggaccgccuccgugacaugc

SEQ ID NO: 76388 - RNA, 39 nt, Artificial Sequence
  p53 wt (25-35)
cuguggaagcuccuucccgagaacaaugugcugagcccu

SEQ ID NO: 76389 - RNA, 45 nt, Artificial Sequence
  p53 wt (108-122)
ggcuucagacugggguuucuccacagcggaaccgccaaguccgug

SEQ ID NO: 76390 - RNA, 42 nt, Artificial Sequence
  p53 wt (153-166)
cccggcaccagagugagggccauggcuaucuacaagcagagc

SEQ ID NO: 76391 - RNA, 123 nt, Artificial Sequence
  BRAF (442-482)
ggcagaagggacagcuccgaugacugggagauccccgaugggcagauuaccgugggacaaauaaucgguucuggcucauucgggacagucuacaagggaaaauggcacggcgacguugccgug

SEQ ID NO: 76392 - RNA, 123 nt, Artificial Sequence
  BRAF (443-483)
agaagggacagcuccgaugacugggagauccccgauggccagauuaccguggggcaacggucuggaucagguaguuucggcacagucuacaaggggaaauggcacggagacguugccgugaag

SEQ ID NO: 76393 - RNA, 123 nt, Artificial Sequence
  BRAF (444-484)
agagacagcuccgaugacugggagauccccgauggccagauuaccguggggcaaaggauagaaucuggaucauucgguacagucuacaagggcaaauggcacggggacguugccgugaagaug

SEQ ID NO: 76394 - RNA, 123 nt, Artificial Sequence
  BRAF (581-621)
aacaucuuccugcacgaggaccucaccgugaagauuggcgauuuugggcuugccacagucgaaagcagaugguccggaucucaucaguucgagcaacugucagguaguauauuguggauggcu

SEQ ID NO: 76395 - RNA, 123 nt, Artificial Sequence
  BRAF (446-486)
agcuccgacgauugggagauccccgacggccagauuaccguggggcaaagaauaggaucugucucauucgguacaguuuacaagggcaaauggcacggggauguggccguaaagaugcugaac

SEQ ID NO: 76396 - RNA, 123 nt, Artificial Sequence
  BRAF (577-617)
cugaagagcaacaauaucuuccuccacgaggaccuuaccgugaaaauuggcgauuuugggagagccacagucaaguccagguggucuggaucacaucaguucgaacaacugagugguagcaua

SEQ ID NO: 76397 - RNA, 123 nt, Artificial Sequence
  BRAF (449-489)
gacugggagauccccgauggccagauuaccguggggcaaagaauaggaagcgguuccuucgccacagucuacaagggcaaauggcacggggacguugcugugaagaugcugaacguaacugca

SEQ ID NO: 76398 - RNA, 123 nt, Artificial Sequence
  BRAF (449-489)
gacugggagauccccgauggccagauuaccguggggcaaagaauaggaagcgguuccuucaggacagucuacaagggcaaauggcacggggacguugccgugaagaugcugaacguaacugcu

SEQ ID NO: 76399 - RNA, 123 nt, Artificial Sequence
  BRAF (574-614)
cacagagaccugaagagcaacaauaucuuccuccaugaggaucuuaccgugaaaauuggcggguuuggacuggccacagucaaguccagguggucugguucacaccaguucgaacaauugagu

SEQ ID NO: 76400 - protein, 9 aa, Artificial Sequence
  Linker 1
SGGSGGSGG

SEQ ID NO: 76401 - protein, 2 aa, Artificial Sequence
  Linker 2
RR

SEQ ID NO: 76402 - protein, 2 aa, Artificial Sequence
  Linker 3
LL

SEQ ID NO: 76403 - protein, 10 aa, Artificial Sequence
  Linker 4
GGGGSGGGGT

SEQ ID NO: 76404 - protein, 9 aa, Artificial Sequence
  Linker 5
GGGGSGGGG

SEQ ID NO: 76405 - protein, 4 aa, Artificial Sequence
  Linker 6
GPSL

SEQ ID NO: 76406 - protein, 8 aa, Artificial Sequence
  Linker 7
GSTVAAPS

SEQ ID NO: 76407 - protein, 8 aa, Artificial Sequence
  Linker 8
TVAAPSGS

SEQ ID NO: 76408 - protein, 10 aa, Artificial Sequence
  Linker 9
GSTVAAPSGS

SEQ ID NO: 76409 - protein, 5 aa, Artificial Sequence
  Linker 10
GGGGS

SEQ ID NO: 76410 - protein, 6 aa, Artificial Sequence
  Linker 11
TVAAPS

SEQ ID NO: 76411 - protein, 2 aa, Artificial Sequence
  Linker 12
GS

SEQ ID NO: 76412 - protein, 3 aa, Artificial Sequence
  Linker 13
PAS

SEQ ID NO: 76413 - protein, 6 aa, Artificial Sequence
  Linker 14
PAVPPP

SEQ ID NO: 76414 - protein, 6 aa, Artificial Sequence
  Linker 15
TVSDVP

SEQ ID NO: 76415 - protein, 6 aa, Artificial Sequence
  Linker 16
TGLDSP

SEQ ID NO: 76416 - protein, 11 aa, Artificial Sequence
  Linker 17
HYGAEALERAG

SEQ ID NO: 76417 - protein, 3 aa, Artificial Sequence
  Linker 18
AAY

SEQ ID NO: 76418 - protein, 4 aa, Artificial Sequence
  Linker 19
AAAA

SEQ ID NO: 76419 - protein, 15 aa, Artificial Sequence
  CV Linker
GGGGSGGGGSGGGGS

SEQ ID NO: 76420 - protein, 9 aa, Artificial Sequence
  Prostate-specific antigen precursor (17-25)
AAPLILSRI

SEQ ID NO: 76421 - protein, 9 aa, Artificial Sequence
  Prostate-specific antigen precursor (65-73)
HCIRNKSVI

SEQ ID NO: 76422 - protein, 10 aa, Artificial Sequence
  Prostate-specific antigen precursor (65-74)
HCIRNKSVIL

SEQ ID NO: 76423 - protein, 9 aa, Artificial Sequence
  Prostate-specific antigen precursor (82-90)
HPEDTGQVF

SEQ ID NO: 76424 - protein, 9 aa, Artificial Sequence
  Prostate-specific antigen precursor (188-196)
HPQKVTKFM

SEQ ID NO: 76425 - protein, 9 aa, Artificial Sequence
  Prostate-specific antigen precursor (243-251)
YTKVVHYRK

SEQ ID NO: 76426 - protein, 10 aa, Artificial Sequence
  Prostate-specific antigen precursor (178-187)
VISNDVCAQV

SEQ ID NO: 76427 - protein, 15 aa, Artificial Sequence
  Prostate-specific antigen precursor (88-102)
QVFQVSHSFPHPLYD

SEQ ID NO: 76428 - protein, 9 aa, Artificial Sequence
  Kita-kyushu lung cancer antigen 1 (40-48)
LVRPSSSGL

SEQ ID NO: 76429 - protein, 11 aa, Artificial Sequence
  Trophoblast glycoprotein (104-114)
AVLPAGAFARR

SEQ ID NO: 76430 - protein, 9 aa, Artificial Sequence
  Trophoblast glycoprotein (33-41)
SPTSSASSF

SEQ ID NO: 76431 - protein, 9 aa, Artificial Sequence
  Cyclin-dependent kinase inhibitor 2A (68-76)
AEELGHRDV

SEQ ID NO: 76432 - protein, 10 aa, Artificial Sequence
  Cyclin-dependent kinase inhibitor 2A, isoforms 1/2/3 (87-96)
REGFLDTLVV

SEQ ID NO: 76433 - protein, 11 aa, Artificial Sequence
  Cyclin-dependent kinase inhibitor 2A, isoforms 1/2/3 (87-97)
REGFLDTLVVL

SEQ ID NO: 76434 - protein, 9 aa, Artificial Sequence
  multiple tumor suppressor 1/cyclin-dependent kinase 4 inhibitor p16, partial (7-15)
ARVAELLLL

SEQ ID NO: 76435 - protein, 9 aa, Artificial Sequence
  multiple tumor suppressor 1/cyclin-dependent kinase 4 inhibitor p16, partial (52-60)
ARLDVRDAW

SEQ ID NO: 76436 - protein, 9 aa, Artificial Sequence
  multiple tumor suppressor 1/cyclin-dependent kinase 4 inhibitor p16, partial (63-71)
LPVDLAEEL

SEQ ID NO: 76437 - protein, 13 aa, Artificial Sequence
  Cyclin-dependent kinase inhibitor 2A, isoforms 1/2/3 (111-123)
GRLPVDLAEELGH

SEQ ID NO: 76438 - protein, 9 aa, Artificial Sequence
  Cyclin-dependent kinase inhibitor 2A (58-66)
RVAELLLLH

SEQ ID NO: 76439 - protein, 10 aa, Artificial Sequence
  GTPase NRas (55-64)
ILDTAGQEEY

SEQ ID NO: 76440 - protein, 766 aa, Artificial Sequence [sequence omitted]

SEQ ID NO: 76441 - protein, 1068 aa, Artificial Sequence
  P42336 PK3CA
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 76442 - protein, 189 aa, Artificial Sequence [sequence omitted]

SEQ ID NO: 76443 - protein, 414 aa, Artificial Sequence
  O75874 IDHC
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 76444 - protein, 393 aa, Artificial Sequence [sequence omitted]

SEQ ID NO: 76445 - protein, 189 aa, Artificial Sequence
  P01111 RASN
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 76446 - protein, 480 aa, Artificial Sequence [sequence omitted]

SEQ ID NO: 76447 - protein, 1304 aa, Artificial Sequence
  O75533 SF3B1
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGGKTPDPKMNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 76448 - protein, 156 aa, Artificial Sequence
  P42771 CDN2A
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 76449 - protein, 1210 aa, Artificial Sequence [sequence omitted]

SEQ ID NO: 76450 - protein, 180 aa, Artificial Sequence
  P78358 CTG1B
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 76451 - protein, 1255 aa, Artificial Sequence
  P15941 MUC1
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 76452 - protein, 420 aa, Artificial Sequence
  Q13641 TPBG
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 76453 - protein, 1255 aa, Artificial Sequence [sequence omitted]

SEQ ID NO: 76454 - protein, 314 aa, Artificial Sequence
  P43357 MAGA3
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 76455 - protein, 165 aa, Artificial Sequence
  Q17RY6 LY6K
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 76456 - protein, 344 aa, Artificial Sequence
  P40199 CEAM6
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 76457 - protein, 449 aa, Artificial Sequence
  P19544 WT1
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 76458 - protein, 702 aa, Artificial Sequence
  P06731 CEAM5
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 76459 - protein, 725 aa, Artificial Sequence
  Q99661 KIF2C
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 76460 - protein, 113 aa, Artificial Sequence
  Q5H943 KKLC1
MNFYLLLASSILCALIVFWKYRRFQRNTGEMSSNSTALALVRPSSSGLINSNTDNNLAVYDLSRDILNNFPHSIARQKRILVNLSMVENKLVELEHTLLSKGFRGASPHRKST

SEQ ID NO: 76461 - protein, 101 aa, Artificial Sequence
  P01350 GAST
MQRLCVYVLIFALALAAFSEASWKPRSQQPDAPLGTGANRDLELPWLEQQGPASHHRRQLGPQGPPHLVADPSKKQGPWLEEEEEAYGWMDFGRRSAEDEN

SEQ ID NO: 76462 - protein, 1356 aa, Artificial Sequence
  P35968 VGFR2
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 76463 - protein, 267 aa, Artificial Sequence
  P09237 MMP7
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 76464 - protein, 1820 aa, Artificial Sequence
  Q96Q89 KI20B
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDIIDSLQDNVADIKKQAEIAHLYIASLPDPQEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVECSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 76465 - protein, 317 aa, Artificial Sequence
  P43358 MAGA4
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 76466 - protein, 309 aa, Artificial Sequence
  P43355 MAGA1
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 76467 - protein, 1142 aa, Artificial Sequence
  O60732 MAGC1
MGDKDMPTAGMPSLLQSSSESPQSCPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESTQSPFEGFPQSVLQIPVSAASSSTLVSIFQSSPESTQSPFEGFPQSPLQIPVSRSFSSTLLSIFQSSPERTQSTFEGFAQSPLQIPVSPSSSSTLLSLFQSFSERTQSTFEGFAQSSLQIPVSPSFSSTLVSLFQSSPERTQSTFEGFPQSPLQIPVSSSSSSTLLSLFQSSPERTHSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTHSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSPQGEDSLSPHYFPQSPPQGEDSMSPLYFPQSPLQGEEFQSSLQSPVSICSSSTPSSLPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVSSFPSSTSSSLSKSSPESPLQSPVISFSSSTSLSPFSEESSSPVDEYTSSSDTLLESDSLTDSESLIESEPLFTYTLDEKVDELARFLLLKYQVKQPITKAEMLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 76468 - protein, 509 aa, Artificial Sequence
  P78395 PRAME
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 76469 - protein, 142 aa, Artificial Sequence
  O15392 BIRC5
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 76470 - protein, 315 aa, Artificial Sequence
  P43362 MAGA9
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLGEEQEGV

SEQ ID NO: 76471 - protein, 373 aa, Artificial Sequence
  Q9UBF1 MAGC2
MPPVPGVPFRNVDNDSPTSVELEDWVDAQHPTDEEEEEASSASSTLYLVFSPSSFSTSSSLILGGPEEEEVPSGVIPNLTESIPSSPPQGPPQGPSQSPLSSCCSSFSWSSFSEESSSQKGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 76472 - protein, 821 aa, Artificial Sequence
  P21802 FGFR2
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 76473 - protein, 261 aa, Artificial Sequence
  P07288 KLK3
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 76474 - protein, 750 aa, Artificial Sequence
  Q04609 FOLH1
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 76475 - RNA, 27 nt, Artificial Sequence
  Linker 1
agcggcggguccggcgggagcggcggg

SEQ ID NO: 76476 - RNA, 6 nt, Artificial Sequence
  Linker 2
cgccgg

SEQ ID NO: 76477 - RNA, 6 nt, Artificial Sequence
  Linker 3
cugcuc

SEQ ID NO: 76478 - RNA, 30 nt, Artificial Sequence
  Linker 4
ggcgggggcgggagcggcgggggcggcacc

SEQ ID NO: 76479 - RNA, 27 nt, Artificial Sequence
  Linker 5
ggcgggggcgggagcggcgggggcggc

SEQ ID NO: 76480 - RNA, 12 nt, Artificial Sequence
  Linker 6
ggccccagccug

SEQ ID NO: 76481 - RNA, 24 nt, Artificial Sequence
  Linker 7
ggcagcaccguggccgcccccucc

SEQ ID NO: 76482 - RNA, 24 nt, Artificial Sequence
  Linker 8
accguggccgcccccagcggcucc

SEQ ID NO: 76483 - RNA, 30 nt, Artificial Sequence
  Linker 9
ggcagcaccguggccgcccccuccgggagc

SEQ ID NO: 76484 - RNA, 15 nt, Artificial Sequence
  Linker 10
ggcgggggcgggagc

SEQ ID NO: 76485 - RNA, 18 nt, Artificial Sequence
  Linker 11
accguggccgcccccagc

SEQ ID NO: 76486 - RNA, 6 nt, Artificial Sequence
  Linker 12
ggcagc

SEQ ID NO: 76487 - RNA, 9 nt, Artificial Sequence
  Linker 13
cccgccagc

SEQ ID NO: 76488 - RNA, 18 nt, Artificial Sequence
  Linker 14
cccgccgugccgcccccc

SEQ ID NO: 76489 - RNA, 18 nt, Artificial Sequence
  Linker 15
accgugagcgacgucccc

SEQ ID NO: 76490 - RNA, 18 nt, Artificial Sequence
  Linker 16
accggccuggacagcccc

SEQ ID NO: 76491 - RNA, 33 nt, Artificial Sequence
  Linker 17
cacuacggcgccgaggcccuggagcgcgcgggg

SEQ ID NO: 76492 - RNA, 9 nt, Artificial Sequence
  Linker 18
gccgccuac

SEQ ID NO: 76493 - RNA, 12 nt, Artificial Sequence
  Linker 19
gccgccgcggcc

SEQ ID NO: 76494 - RNA, 45 nt, Artificial Sequence
  CV Linker
ggcgggggcgggagcggcgggggcggcuccgggggcgggggcagc

SEQ ID NO: 76495 - RNA, 27 nt, Artificial Sequence
  Prostate-specific antigen precursor (17-25)
gccgccccccugauccucagccgcauc

SEQ ID NO: 76496 - RNA, 27 nt, Artificial Sequence
  Prostate-specific antigen precursor (65-73)
cacugcauccgcaacaagagcgugauc

SEQ ID NO: 76497 - RNA, 30 nt, Artificial Sequence
  Prostate-specific antigen precursor (65-74)
cacugcauccgcaacaagagcgugauccug

SEQ ID NO: 76498 - RNA, 27 nt, Artificial Sequence
  Prostate-specific antigen precursor (82-90)
caccccgaggacaccggccagguguuc

SEQ ID NO: 76499 - RNA, 27 nt, Artificial Sequence
  Prostate-specific antigen precursor (188-196)
cacccccagaaggugaccaaguucaug

SEQ ID NO: 76500 - RNA, 27 nt, Artificial Sequence
  Prostate-specific antigen precursor (243-251)
uacaccaaggugguccacuaccgcaag

SEQ ID NO: 76501 - RNA, 30 nt, Artificial Sequence
  Prostate-specific antigen precursor (178-187)
gugaucagcaacgacgucugcgcccaggug

SEQ ID NO: 76502 - RNA, 45 nt, Artificial Sequence
  Prostate-specific antigen precursor (88-102)
cagguguuccaggucagccacuccuucccccacccgcuguacgac

SEQ ID NO: 76503 - RNA, 27 nt, Artificial Sequence
  Kita-kyushu lung cancer antigen 1 (40-48)
cuggugcgccccagcuccagcggccuc

SEQ ID NO: 76504 - RNA, 33 nt, Artificial Sequence
  Trophoblast glycoprotein (104-114)
gccgugcugcccgccggcgcguucgcccgccgg

SEQ ID NO: 76505 - RNA, 27 nt, Artificial Sequence
  Trophoblast glycoprotein (33-41)
agccccaccuccagcgccuccagcuuc

SEQ ID NO: 76506 - RNA, 27 nt, Artificial Sequence
  Cyclin-dependent kinase inhibitor 2A (68-76)
gccgaggagcugggccaccgcgacgug

SEQ ID NO: 76507 - RNA, 30 nt, Artificial Sequence
  Cyclin-dependent kinase inhibitor 2A, isoforms 1/2/3 (87-96)
cgcgagggcuuccuggacacccucgugguc

SEQ ID NO: 76508 - RNA, 33 nt, Artificial Sequence
  Cyclin-dependent kinase inhibitor 2A, isoforms 1/2/3 (87-97)
cgcgagggcuuccuggacacccucgugguccug

SEQ ID NO: 76509 - RNA, 27 nt, Artificial Sequence
  multiple tumor suppressor 1/cyclin-dependent kinase 4 inhibitor p16, partial (7-15)
gcccgcguggccgagcugcuccugcug

SEQ ID NO: 76510 - RNA, 27 nt, Artificial Sequence
  multiple tumor suppressor 1/cyclin-dependent kinase 4 inhibitor p16, partial (52-60)
gcccgccuggacgugcgggacgccugg

SEQ ID NO: 76511 - RNA, 27 nt, Artificial Sequence
  multiple tumor suppressor 1/cyclin-dependent kinase 4 inhibitor p16, partial (63-71)
cugcccguggaccucgccgaggagcug

SEQ ID NO: 76512 - RNA, 39 nt, Artificial Sequence
  Cyclin-dependent kinase inhibitor 2A, isoforms 1/2/3 (111-123)
ggccgccugcccguggaccucgccgaggagcuggggcac

SEQ ID NO: 76513 - RNA, 27 nt, Artificial Sequence
  Cyclin-dependent kinase inhibitor 2A (58-66)
cgcguggccgagcugcuccugcugcac

SEQ ID NO: 76514 - RNA, 30 nt, Artificial Sequence
  GTPase NRas (55-64)
auccuggacaccgccggccaggaggaguac

SEQ ID NO: 76515 - RNA, 2298 nt, Artificial Sequence
  P15056 BRAF
auggccgcccugagcggcgggggcgggggcggggcggagcccggccaggcccucuucaacggcgacauggagccggaggccggggccggcgccggggcggccgccuccagcgccgcggaccccgccauccccgaggagguguggaacaucaagcagaugaucaagcugacccaggagcacaucgaggcccugcucgacaaguucggcggggagcacaaccccccguccaucuaccuggaggccuacgaggaguacaccagcaagcuggacgcccuccagcagcgcgagcagcagcugcuggagucccucggcaacggcacggacuucagcgucuccagcuccgcgagcauggacaccgugaccuccagcuccagcuccagccuguccgugcugcccagcucccucagcgucuuccagaaccccaccgacguggcccggagcaaccccaaguccccgcagaagcccaucgugcgcgucuuccugcccaacaagcagcggacgguggugcccgcccgcugcggggucaccgugcgggacagccugaagaaggcccucaugaugcgcggccugaucccggagugcugcgccguguaccggauccaggacggggagaagaagcccaucggcugggacaccgacaucuccuggcugaccggcgaggagcuccacgucgaggugcuggagaacgugccccugacgacccacaacuucguccgcaagaccuucuucacccucgcguucugcgacuucugccggaagcugcuguuccagggguuccgcugccagacgugcggcuacaaguuccaccagcggugcagcaccgaggugccccucaugugcgugaacuacgaccagcuggaccugcucuucgucuccaaguucuucgagcaccacccgaucccccaggaggaggccagccuggccgagaccgcccugaccuccgggagcucccccagcgcccccgcguccgacagcaucggcccgcagauccucacgucccccagccccuccaagagcauccccaucccgcagcccuuccgccccgccgacgaggaccaccggaaccaguucgggcagcgcgaccgguccagcuccgcccccaacgugcacaucaacaccaucgagccggugaacaucgacgaccugauccgcgaccagggcuuccggggcgacgggggcagcaccaccgggcugagcgccacgccccccgccucccucccgggcagccugaccaacgucaaggcgcugcagaagucccccgggccccagcgcgagcggaagagcuccagcuccagcgaggaccgcaaccggaugaagacccucggccgccgcgacuccagcgacgacugggagauccccgacggccagaucaccguggggcagcggaucggcuccgggagcuucggcacgguguacaaggggaaguggcacggcgacgucgccgugaagaugcugaacgucaccgccccgaccccccagcagcugcaggccuucaagaacgaggugggcgugcuccgcaagacccggcacgucaacauccugcuguucaugggguacuccacgaagccccagcucgcgaucgugacccaguggugcgagggcagcucccuguaccaccaccugcacaucaucgagaccaaguucgagaugaucaagcucaucgacaucgcccgccagaccgcccaggggauggacuaccugcacgccaagagcaucauccaccgggaccugaaguccaacaacaucuuccuccacgaggaccugacggugaagaucggcgacuucggccuggccaccgucaagagccgcuggagcgggucccaccaguucgagcagcugagcggcuccauccucuggauggcgcccgaggugauccggaugcaggacaagaacccguacagcuuccaguccgacguguacgccuucgggaucguccuguacgagcugaugaccggccagcuccccuacagcaacaucaacaaccgcgaccagaucaucuucaugguggggcggggcuaccugucccccgaccugagcaaggugcgcuccaacugccccaaggccaugaagcggcucauggccgagugccugaagaagaagcgcgacgagcggccgcuguucccccagauccucgccagcaucgagcugcuggcgcgcucccuccccaagauccaccggagcgccuccgagcccagccugaaccgcgccggcuuccagaccgaggacuucucccuguacgccugcgccagcccgaagacgcccauccaggcggggggcuacggggccuuccccguccac

SEQ ID NO: 76516 - RNA, 3204 nt, Artificial Sequence
  P42336 PK3CA
augcccccgcgccccagcuccggcgagcugugggggauccaccucaugcccccccggauccugguggagugccugcucccgaacggcaugaucgucacccuggagugccugcgcgaggccacccucaucacgaucaagcacgagcuguucaaggaggcccggaaguacccccugcaccagcuccugcaggacgagagcuccuacaucuucgugagcgugacccaggaggcggagcgcgaggaguucuucgacgagacccggcgccugugcgaccuccggcuguuccagcccuuccugaaggucaucgagcccguggggaaccgcgaggagaagauccucaaccgggagaucggcuucgccaucgggaugccggugugcgaguucgacauggucaaggaccccgaggugcaggacuuccgccggaacauccugaacgugugcaaggaggccgucgaccugcgcgaccucaacuccccccacagccgggccauguacguguaccccccgaacguggaguccagccccgagcugcccaagcacaucuacaacaagcuggacaagggccagaucaucgucgugaucugggugaucgucucccccaacaacgacaagcagaaguacacccucaagaucaaccacgacugcgugccggagcaggugaucgccgaggcgauccgcaagaagacgcggagcaugcugcuguccagcgagcagcucaagcugugcguccuggaguaccagggcaaguacauccucaaggugugcgggugcgacgaguacuuccuggagaaguacccccugucccaguacaaguacauccgcagcugcaucaugcucggccggaugcccaaccugaugcugauggccaaggagucccucuacagccagcugcccauggacugcuucaccaugccguccuacagccgccggaucuccaccgccacccccuacaugaacggggagacgagcaccaagagccugugggugaucaacuccgcccuccgcaucaagauccugugcgcgaccuacgucaacgugaacauccgggacaucgacaagaucuacgugcgcaccggcaucuaccacgggggcgagccccugugcgacaacgucaacacgcagcgcgugcccugcagcaacccgcgguggaacgaguggcucaacuacgacaucuacauccccgaccugccccgcgccgcccggcugugccucuccaucugcagcgucaagggccgcaagggggccaaggaggagcacugcccccuggccuggggcaacaucaaccuguucgacuacaccgacacccucguguccgggaagauggcgcugaaccuguggccggugccccacggccucgaggaccugcugaaccccaucggcgucaccgggagcaacccgaacaaggagacgcccugccuggagcucgaguucgacugguucuccagcguggugaaguuccccgacauguccgucaucgaggagcacgccaacuggagcgugucccgggaggccggcuucagcuacucccacgccgggcugagcaaccgccuggcccgggacaacgagcuccgcgagaacgacaaggagcagcugaaggcgaucuccacccgggacccccugagcgagaucaccgagcaggagaaggacuuccucuggucccaccgccacuacugcgugaccaucccggagauccugcccaagcugcuccugagcgucaaguggaacucccgggacgagguggcccagauguacugccuggugaaggacuggccccccaucaagccggagcaggccauggagcuccuggacugcaacuaccccgaccccaugguccgcggcuucgccgugcggugccuggagaaguaccucacggacgacaagcugagccaguaccugauccagcucgugcagguccugaaguacgagcaguaccuggacaaccuccuggugcgcuuccugcucaagaaggcccugaccaaccagcggaucgggcacuucuucuucuggcaccugaagagcgagaugcacaacaagaccgugucccagcgcuucggccuccugcuggagagcuacugccgggcgugcggcauguaccucaagcaccugaaccgccaggucgaggccauggagaagcugaucaaccucaccgacauccugaagcaggagaagaaggacgagacgcagaaggugcagaugaaguuccugguggagcagaugcggcgccccgacuucauggacgcccuccagggguuccuguccccgcugaaccccgcccaccagcucggcaaccugcgccuggaggagugccggaucaugagcuccgccaagcgcccccucuggcugaacugggagaaccccgacaucaugagcgagcugcucuuccagaacaacgagaucaucuucaagaacggggacgaccugcggcaggacaugcugacccuccagaucauccgcaucauggagaacaucuggcagaaccagggccuggaccugcggaugcucccguacgggugccuguccaucggcgacugcgucggccugaucgagguggugcgcaacagccacaccaucaugcagauccagugcaaggggggccucaagggggcgcugcaguucaacucccacacccugcaccaguggcucaaggacaagaacaagggcgagaucuacgacgccgccaucgaccuguucacgcggagcugcgccggguacugcgucgcgaccuucauccugggcaucggcgaccgccacaacuccaacaucauggugaaggacgacgggcagcucuuccacaucgacuucggccacuuccuggaccacaagaagaagaaguucggguacaagcgggagcgcgugcccuucguccugacccaggacuuccucaucgugaucagcaagggcgcccaggagugcaccaagacgcgggaguucgagcgcuuccaggagaugugcuacaaggccuaccuggccauccggcagcacgccaaccuguucaucaaccucuucuccaugaugcugggcagcgggaugcccgagcugcaguccuucgacgacaucgcguacauccgcaagacccucgcccuggacaagaccgagcaggaggcccuggaguacuucaugaagcagaugaacgacgcccaccacggcggguggaccacgaagauggacuggaucuuccacaccaucaagcagcacgcccucaac

SEQ ID NO: 76517 - RNA, 567 nt, Artificial Sequence
  P01116 RASK
augaccgaguacaagcugguggucgugggcgccgggggcguggggaagagcgcccucaccauccagcugauccagaaccacuucgucgacgaguacgaccccacgaucgaggacuccuaccgcaagcagguggugaucgacggcgagaccugccugcucgacauccuggacaccgcggggcaggaggaguacagcgccaugcgggaccaguacaugcgcaccggcgagggcuuccugugcgucuucgccaucaacaacacgaaguccuucgaggacauccaccacuaccgggagcagaucaagcgcgugaaggacagcgaggacgugccgaugguccucguggggaacaagugcgaccugcccucccggaccguggacaccaagcaggcccaggaccuggcccgcagcuacggcauccccuucaucgagaccuccgcgaagacgcggcagcgcgucgaggacgccuucuacacccucgugcgggagauccgccaguaccggcugaagaagaucagcaaggaggagaagacccccgggugcgugaagaucaagaagugcaucaucaug

SEQ ID NO: 76518 - RNA, 1242 nt, Artificial Sequence
  O75874 IDHC
augagcaagaagaucuccggcgggagcguggucgagaugcagggcgacgagaugacccgcaucaucugggagcugaucaaggagaagcucaucuuccccuacguggagcuggaccugcacuccuacgaccucgggaucgagaaccgggacgccaccaacgaccaggugacgaaggacgccgcggaggccaucaagaagcacaacgucggcgugaagugcgccaccaucaccccggacgagaagcgcguggaggaguucaagcugaagcagauguggaagagccccaacgggaccauccggaacauccugggcggcacggucuuccgcgaggccaucaucugcaagaacaucccccggcucguguccgggugggugaagcccaucaucaucggccgccacgccuacggggaccaguaccgggcgaccgacuucgucgugccgggccccgggaagguggagaucaccuacacccccagcgacggcacgcagaaggucaccuaccuggugcacaacuucgaggagggcgggggcguggccauggggauguacaaccaggacaaguccaucgaggacuucgcccacagcuccuuccagauggcccugagcaagggcuggccccucuaccuguccaccaagaacaccauccugaagaaguacgacggccgcuucaaggacaucuuccaggagaucuacgacaagcaguacaagagccaguucgaggcgcagaagaucugguacgagcaccggcucaucgacgacauggucgcccaggccaugaaguccgaggggggcuucaucugggccugcaagaacuacgacggggacgugcagagcgacuccguggcccagggcuacgggagccugggcaugaugacguccguccuggugugcccggacggcaagaccguggaggcggaggccgcccacgggaccgucacccgccacuaccggauguaccagaagggccaggagacgagcaccaaccccaucgccuccaucuucgccuggacccgcgggcucgcgcaccgggccaagcuggacaacaacaaggagcuggccuucuucgccaacgcccucgaggaggugagcaucgagaccaucgaggcgggcuucaugacgaaggaccuggccgccugcaucaaggggcugcccaacgugcagcgcagcgacuaccucaacaccuucgaguucauggacaagcugggcgagaaccugaagaucaagcucgcccaggccaagcug

SEQ ID NO: 76519 - RNA, 1179 nt, Artificial Sequence
  P04637 P53
auggaggagccccagagcgacccguccguggagcccccccugagccaggagaccuucuccgaccucuggaagcugcugcccgagaacaacguccucagcccgcugcccucccaggccauggacgaccugaugcucagccccgacgacaucgagcagugguucaccgaggaccccggcccggacgaggccccccgcaugcccgaggcggcccccccgguggcccccgcccccgccgcgcccacgccggccgcccccgcccccgcgcccuccuggccgcugagcuccagcgugcccucccagaagaccuaccaggggagcuacggcuuccggcugggguuccuccacuccggcaccgccaagagcgucaccugcacguacucccccgcccugaacaagauguucugccagcuggccaagaccugccccgugcagcucuggguggacagcaccccgccccccgggacccgcguccgggccauggcgaucuacaagcagucccagcacaugacggagguggugcgccggugcccccaccacgagcgcugcagcgacuccgacggccuggccccgccccagcaccugauccgggucgagggcaaccuccgcguggaguaccuggacgaccggaacaccuuccgccacagcguggucgugcccuacgagccgcccgagguggggagcgacugcaccaccauccacuacaacuacaugugcaacuccagcugcaugggcgggaugaaccggcgccccauccugacgaucaucacccucgaggacuccagcggcaaccugcuggggcggaacuccuucgagguccgcgugugcgccugccccggccgggaccgccggaccgaggaggagaaccuccgcaagaagggcgagccgcaccacgagcugccccccgggagcaccaagcgggcccugcccaacaacacguccagcuccccgcagcccaagaagaagccccucgacggcgaguacuucacccugcagauccgcgggcgggagcgcuucgagauguuccgcgagcugaacgaggcccucgagcugaaggacgcgcaggccggcaaggagcccggcgggagccgggcccacuccagccaccugaaguccaagaagggccagagcaccucccgccacaagaagcucauguucaagaccgaggggccggacagcgac

SEQ ID NO: 76520 - RNA, 567 nt, Artificial Sequence
  P01111 RASN
augaccgaguacaagcugguggucgugggcgccgggggcguggggaagagcgcccucaccauccagcugauccagaaccacuucgucgacgaguacgaccccacgaucgaggacuccuaccgcaagcagguggugaucgacggcgagaccugccugcucgacauccuggacaccgcggggcaggaggaguacagcgccaugcgggaccaguacaugcgcaccggcgagggcuuccugugcgucuucgccaucaacaacuccaagagcuucgccgacaucaaccucuaccgggagcagaucaagcgcgugaaggacuccgacgacgugccgaugguccugguggggaacaagugcgaccugcccacgcggaccguggacaccaagcaggcccacgagcucgcgaagagcuacggcauccccuucaucgagaccuccgccaagacgcgccagggggucgaggacgccuucuacacccuggugcgggagauccgccaguaccggaugaagaagcugaacagcuccgacgacggcacccaggggugcaugggccuccccugcguggucaug

SEQ ID NO: 76521 - RNA, 1440 nt, Artificial Sequence
  P31749 AKT1
augagcgacguggccaucgucaaggagggcuggcugcacaagcgcggggaguacaucaagaccuggcggccccgcuacuuccuccugaagaacgacggcaccuucaucggguacaaggagcggccgcaggacguggaccagcgcgaggccccccugaacaacuucuccguggcgcagugccagcucaugaagacggagcggccccgccccaacaccuucaucauccggugccugcaguggaccaccgucaucgagcgcacguuccacguggagaccccggaggagcgggaggaguggaccaccgccauccagacgguggccgacggccugaagaagcaggaggaggaggagauggacuuccgcagcgggucccccagcgacaacuccggcgccgaggagauggaggucagccucgccaagcccaagcaccgggugaccaugaacgaguucgaguaccugaagcugcucggcaaggggaccuucggcaaggugauccuggucaaggagaaggcgaccgggcgcuacuacgccaugaagauccugaagaaggaggugaucguggccaaggacgaggucgcccacacgcucaccgagaaccgggugcugcagaacucccgccaccccuuccugaccgcgcucaaguacagcuuccagacccacgaccggcugugcuucgugauggaguacgccaacggcggggagcuguucuuccaccucucccgcgagcgggucuucagcgaggaccgcgcccgguucuacggcgccgagaucguguccgcccuggacuaccugcacagcgagaagaacguggucuaccgcgaccucaagcuggagaaccugaugcucgacaaggacggccacaucaagaucacggacuucgggcugugcaaggagggcaucaaggacggggcgaccaugaagaccuucugcggcaccccggaguaccuggcccccgaggugcucgaggacaacgacuacggccgggccguggacuggugggggcugggcgucgugauguacgagaugaugugcgggcgccugcccuucuacaaccaggaccacgagaagcucuucgagcugauccugauggaggagauccgcuucccccggacgcucggcccggaggccaagucccugcugagcgggcuccugaagaaggaccccaagcagcgccugggcggcggguccgaggacgccaaggagaucaugcagcaccgguucuucgcgggcaucguguggcagcacgucuacgagaagaagcucagcccccccuucaagccgcaggugaccuccgagaccgacacccgcuacuucgacgaggaguucacggcccagaugaucaccaucaccccccccgaccaggacgacagcauggagugcgucgacuccgagcggcgcccccacuucccgcaguucagcuacagcgccuccgggaccgcc

SEQ ID NO: 76522 - RNA, 3912 nt, Artificial Sequence
  O75533 SF3B1
auggccaagaucgccaagacccacgaggacaucgaggcgcagauccgcgagauccagggcaagaaggccgcccuggacgaggcccagggggugggccucgacagcaccggguacuacgaccaggagaucuacggcggguccgacagccgguucgccggcuacgucacguccaucgcggccaccgagcuggaggacgacgacgacgacuacagcuccagcaccucccugcucggccagaagaagcccggguaccacgccccgguggcccugcugaacgacaucccccagagcaccgagcaguacgaccccuucgcggagcaccgccccccgaagaucgccgaccgggaggacgaguacaagaagcaccgccggacgaugaucaucucccccgagcgccucgaccccuucgccgacggcgggaagacccccgacccgaagaugaacgcccggaccuacauggacgugaugcgcgagcagcaccugaccaaggaggagcgggagauccgccagcagcuggccgagaaggcgaaggccggcgagcucaaggucgugaacggggccgccgccagccagccccccuccaagcggaagcgccggugggaccagacggcggaccagacccccggcgccaccccgaagaagcugagcuccugggaccaggccgagacccccggccacacgcccagccugcgcugggacgagacccccgggcgggccaagggcuccgagaccccgggggccacccccggcagcaagaucugggaccccacgcccucccacaccccggcgggcgccgccacccccgggcgcggcgacacccccgggcacgccacgcccggccacgggggcgccaccagcuccgcgcggaagaaccgcugggacgagaccccgaagaccgagcgggacacgcccggccacgggagcggcugggccgagaccccccgcaccgaccgggggggcgacagcaucggggagacccccacgccgggcgccuccaagcgcaagagccgcugggacgagacccccgccucccagaugggcgggagcacccccgugcucaccccgggcaagacgcccaucgggacccccgcgaugaacauggccacccccaccccgggccacaucauguccaugacgcccgagcagcugcaggccuggcggugggagcgcgagaucgacgagcggaaccgcccccugagcgacgaggagcucgacgccauguuccccgagggguacaagguccugccgccccccgccggcuacgugcccauccggaccccggcgcgcaagcugaccgccacccccaccccccucggcgggaugacgggcuuccacaugcagaccgaggaccggaccaugaaguccgugaacgaccagcccagcgggaaccugccguuccugaagcccgacgacauccaguacuucgacaagcuccuggucgacguggacgaguccacccugagccccgaggagcagaaggagcgcaagaucaugaagcuccugcugaagaucaagaacggcacgcccccgaugcggaaggccgcccuccgccagaucaccgacaaggcccgggaguucggcgcggggccccuguucaaccagauccugccccuccugaugucccccacccuggaggaccaggagcgccaccuccuggugaaggucaucgaccggauccuguacaagcucgacgaccuggugcgcccguacgugcacaagauccuggucgugaucgagccccuccugaucgacgaggacuacuacgcccggguggagggccgcgagaucaucagcaaccuggccaaggccgccgggcucgcgaccaugaucuccacgaugcggcccgacaucgacaacauggacgaguacguccgcaacaccaccgcccgggccuucgccgugguggcgagcgcccugggcaucccgucccugcuccccuuccugaaggccgucugcaagagcaagaaguccuggcaggcccgccacaccgggaucaagaucgugcagcagaucgccauccugaugggcugcgcgauccucccccaccugcgcagccugguggagaucaucgagcacggccuggucgacgagcagcagaaggugcggacgaucuccgcccucgccaucgccgcccuggcggaggccgccacccccuacgggaucgagagcuucgacagcguccugaagccgcucuggaagggcauccgccagcaccgggggaagggccuggccgccuuccugaaggcgaucggguaccucaucccccugauggacgccgaguacgccaacuacuacacccgcgaggugaugcugauccucauccgggaguuccagucccccgacgaggagaugaagaagaucgugcugaaggucgugaagcagugcugcggcaccgacggcguggaggccaacuacaucaagacggagauccugcccccguucuucaagcacuucuggcagcaccgcauggcgcucgaccggcgcaacuaccggcagcuggucgacaccaccguggagcuggccaacaaggugggggccgccgagaucaucagccgcaucgucgacgaccucaaggacgaggccgagcaguaccggaagauggugauggagaccaucgagaagaucaugggcaaccugggggcggccgacaucgaccacaagcuggaggagcagcucaucgacggcauccuguacgccuuccaggagcagacgaccgaggacuccgugaugcugaacggguucggcaccgucgugaacgcccucggcaagcgcgugaagcccuaccugccccagaucugcgggaccguccuguggcggcucaacaacaagagcgccaaggugcgccagcaggcggccgaccugaucucccggacggccguggucaugaagaccugccaggaggagaagcugaugggccaccucgggguggugcuguacgaguaccugggcgaggaguaccccgagguccucgggagcauccugggcgcccugaaggccaucgugaacgugaucggcaugcacaagaugaccccgcccaucaaggaccuccugccccgccugacccccauccucaagaaccggcacgagaagguccaggagaacugcaucgaccugguggggcgcaucgcggaccggggcgccgaguacguguccgcccgcgaguggaugcggaucugcuucgagcugcucgagcugcugaaggcccacaagaaggccauccgccgcgcgacggucaacaccuucggguacaucgccaaggccaucggcccgcacgacgugcucgccacccugcugaacaaccucaaggugcaggagcggcagaaccgcgucugcaccacgguggcgaucgccaucguggccgagaccugcagccccuucaccguccugcccgcccugaugaacgaguaccgggugcccgagcucaacgugcagaacggcguccugaagucccugagcuuccucuucgaguacaucggggagaugggcaaggacuacaucuacgccgugaccccgcugcuggaggacgcgcucauggaccgcgaccuggugcaccggcagacggccuccgccgucgugcagcacaugagccuggggguguacggcuucgggugcgaggacucccucaaccaccugcugaacuacgucuggcccaacguguucgagaccagcccccacgugauccaggccgucaugggcgcccucgagggccugcgcguggcgaucgggcccugccggaugcugcaguacugccuccagggccuguuccacccggcccgcaaggugcgggacgucuacuggaagaucuacaacuccaucuacaucgggagccaggacgcccugaucgcccacuacccccgcaucuacaacgacgacaagaacaccuacauccgguacgagcucgacuacauccug

SEQ ID NO: 76523 - RNA, 468 nt, Artificial Sequence
  P42771 CDN2A
auggagcccgccgccggcagcuccauggagccgagcgcggacuggcuggccaccgccgccgcccgcgggcggguggaggagguccgcgcgcuccuggaggccggcgcccugcccaacgcccccaacuccuacgggcggcgccccauccaggugaugaugaugggcagcgcgcggguggccgagcuccugcugcuccacggggccgagccgaacugcgccgaccccgccacccugacgcgccccguccacgacgcggcccgggagggcuuccuggacacccucguggugcugcaccgcgccggcgcccggcuggacguccgcgacgccugggggcggcuccccguggaccuggcggaggagcugggccaccgcgacguggcccgguaccuccgcgccgccgccgggggcacccggggguccaaccacgcgcgcaucgacgccgccgagggcccgagcgacauccccgac

SEQ ID NO: 76524 - RNA, 3630 nt, Artificial Sequence
  P00533 EGFR
augcgccccagcggcaccgccggggccgcgcugcucgcccugcuggccgcccucugcccggccucccgggcgcuggaggagaagaaggugugccagggcaccagcaacaagcugacgcagcucgggaccuucgaggaccacuuccugucccugcagcgcauguucaacaacugcgaggucgugcucggcaaccuggagaucaccuacgugcagcggaacuacgaccugagcuuccucaagaccauccaggaggucgccggguacgugcugaucgcccugaacacgguggagcgcaucccccucgagaaccugcagaucauccggggcaacauguacuacgagaacuccuacgcccuggcgguccucagcaacuacgacgccaacaagaccggccugaaggagcugcccaugcgcaaccuccaggagauccugcacggggccgugcgguucuccaacaaccccgcccugugcaacguggagagcauccaguggcgcgacaucgucuccagcgacuuccucuccaacaugagcauggacuuccagaaccaccugggcuccugccagaagugcgacccgagcugccccaacggguccugcuggggcgccggggaggagaacugccagaagcugaccaagaucaucugcgcgcagcagugcagcggccggugccgcggcaagucccccagcgacugcugccacaaccagugcgccgccgggugcaccggcccccgggaguccgacugccucgugugccgcaaguuccgggacgaggccacgugcaaggacaccugcccgccccugaugcuguacaaccccaccaccuaccagauggacgugaaccccgaggggaaguacagcuucggcgccacgugcgucaagaagugcccgcgcaacuacguggugaccgaccacggcagcugcguccgggcgugcggggccgacuccuacgagauggaggaggacggcgugcgcaagugcaagaagugcgaggggcccugccggaaggugugcaacggcaucgggaucggcgaguucaaggacagccucuccaucaacgccaccaacaucaagcacuucaagaacugcaccagcaucuccggcgaccugcacauccugcccgucgccuuccgcggggacagcuucacgcacacccccccgcucgacccccaggagcuggacauccugaagaccgugaaggagaucaccggcuuccuccugauccaggccuggcccgagaaccggacggaccugcacgcguucgagaaccucgagaucauccgcgggcggaccaagcagcacggccaguucucccuggccguggucagccugaacaucaccucccucgggcugcgcagccugaaggagaucuccgacggcgacgugaucaucagcggcaacaagaaccucugcuacgccaacaccaucaacuggaagaagcuguucgggacguccggccagaagaccaagaucaucagcaaccgcggggagaacuccugcaaggccaccggccaggugugccacgcccugugcagccccgaggggugcuggggcccggagccccgggacugcgucuccugccgcaacgugagccggggccgcgagugcgucgacaagugcaaccuccuggagggggagccccgggaguucguggagaacuccgagugcauccagugccaccccgagugccugccgcaggcgaugaacaucaccugcacgggccgcgggcccgacaacugcauccagugcgcccacuacaucgacggcccccacugcgugaagaccugccccgccggcgucaugggggagaacaacacccugguguggaaguacgccgacgcgggccacgugugccaccucugccacccgaacugcaccuacgggugcacgggccccgggcuggagggcugccccaccaacggcccgaagauccccagcaucgccaccgggauggucggcgcccugcuccugcugcucgugguggcccuggggaucggccuguucaugcggcgccggcacaucguccgcaagcggacccuccgccggcugcugcaggagcgcgagcucguggagccccugacgcccagcggggaggccccgaaccaggcgcugcuccggauccugaaggagaccgaguucaagaagaucaaggugcugggcuccggcgccuucgggaccgucuacaagggccucuggauccccgagggggagaaggugaagauccccguggccaucaaggagcugcgcgaggccaccagccccaaggccaacaaggagauccuggacgaggcguacgucauggccuccguggacaacccgcacgugugccggcuccugggcaucugccugaccagcacgguccagcucaucacccagcugaugcccuucgggugccugcucgacuacgugcgcgagcacaaggacaacaucggcucccaguaccugcugaacuggugcgugcagaucgccaagggcaugaacuaccucgaggaccggcgccugguccaccgcgaccuggccgcccggaacgugcucgugaagaccccccagcacgucaagaucaccgacuucgggcuggcgaagcugcucggcgccgaggagaaggaguaccacgccgaggggggcaaggugcccaucaaguggauggcccuggagagcauccugcaccgcaucuacacgcaccaguccgacguguggagcuacggggucaccgugugggagcucaugaccuucggcuccaagccguacgacggcauccccgcgagcgagaucuccagcauccuggagaagggggagcggcugccccagcccccgaucugcaccaucgacguguacaugaucauggucaagugcuggaugaucgacgccgacucccgccccaaguuccgggagcucaucaucgaguucagcaagauggcccgcgacccccagcgguaccuggugauccagggcgacgagcgcaugcaccugcccuccccgacggacagcaacuucuaccgggcccucauggacgaggaggacauggacgacguggucgacgccgacgaguaccugaucccccagcagggguucuucuccagccccagcaccucccgcaccccccugcucagcucccugagcgcgaccuccaacaacagcacgguggccugcaucgaccggaacggccugcaguccugcccgaucaaggaggacagcuuccuccagcgcuacuccagcgaccccaccggcgcccugaccgaggacuccaucgacgacaccuuccugcccgugccggaguacaucaaccagagcguccccaagcggcccgccggguccgugcagaaccccguguaccacaaccagccgcucaaccccgcccccagccgcgacccccacuaccaggacccgcacuccacggcggucggcaaccccgaguaccugaacaccgugcagcccaccugcgugaacagcaccuucgacucccccgcccacugggcccagaaggggagccaccagaucucccuggacaacccggacuaccagcaggacuucuuccccaaggaggccaagcccaacggcaucuucaaggggagcacggccgagaacgcggaguaccuccgggucgccccccagagcuccgaguucaucggcgcc

SEQ ID NO: 76525 - RNA, 540 nt, Artificial Sequence
  P78358 CTG1B
augcaggccgagggccgcgggaccggcgggagcaccggcgacgccgacgggcccggcggcccggggauccccgacggccccgggggcaacgcggggggccccggcgaggccggggccacgggcgggcggggcccgcgcggcgccggggccgcgcgggccuccggccccgggggcggggccccccgcggcccccacggcggggccgcgagcggccugaacgggugcugccggugcggcgcccgcgggccggagucccggcuccuggaguucuaccuggccaugcccuucgccacccccauggaggccgagcucgcgcgccggagccuggcccaggacgcccccccgcugcccgugcccggcguccuccugaaggaguucaccguguccggcaacauccugaccauccgccucacggccgccgaccaccggcagcugcagcugagcaucuccagcugccuccagcagcugucccugcucauguggaucacccagugcuuccugcccguguuccuggcgcagccgcccagcgggcagcgccgg

SEQ ID NO: 76526 - RNA, 3765 nt, Artificial Sequence
  P15941 MUC1
augacccccggcacccagagcccguucuuccugcuccugcugcucacggugcugaccgucgugaccggguccggccacgccagcuccacccccgggggcgagaaggagacgagcgccacccagcgcuccagcgugcccuccagcaccgagaagaacgcggucuccaugaccagcuccgugcugagcucccacagccccggguccggcagcuccacgacccagggccaggacgugacccucgccccggccaccgagcccgccagcggguccgccgcgacguggggccaggacgucaccagcgugcccgugacccggcccgcccuggggagcaccacgccgcccgcccacgacgucaccuccgcccccgacaacaagcccgcgccgggcagcaccgccccccccgcccacggggugaccuccgcccccgacacgcgcccggcccccggcagcaccgcgccccccgcccacggcgugaccuccgccccggacacccggcccgcccccgggagcacggcccccccggcgcacggcgucaccuccgcccccgacacccgccccgcccccgggagcaccgccccgcccgcccacggcgugacguccgcgcccgacacccggccggcccccggcagcaccgccccccccgcccacggggugaccuccgccccggacacgcgccccgcgcccggcagcaccgcccccccggcccacggggucaccuccgcccccgacacccggcccgcgcccggcagcacggccccgcccgcccacggggugaccuccgcccccgacacccgccccgccccgggcagcaccgcgccccccgcccacggcgugaccuccgcccccgacacgcggccggcccccgggagcaccgccccccccgcgcacggcgucaccuccgccccggacacccgccccgcccccgggagcacggccccgcccgcccacggcgugaccagcgcgcccgacacccggcccgccccgggguccaccgccccccccgcccacggcgugacgagcgcgcccgacacccgcccggcccccggcuccaccgccccccccgcccacggggucaccagcgccccggacacgcggcccgcgcccggcuccaccgcccccccggcccacggggugaccagcgcccccgacacccgccccgcccccggcuccacggcgccgcccgcccacggggugaccagcgcccccgacacccggcccgccccgggcuccaccgccccccccgcgcacggcgucacgagcgcccccgacacccgcccggcccccggguccaccgcccccccggcgcacggcgugaccagcgcccccgacacgcggcccgcccccggguccaccgccccgcccgcccacggcgucaccagcgcgcccgacacccgccccgccccgggcuccacggccccccccgcccacggggugaccagcgcccccgacacccggccggcgcccggcuccaccgccccccccgcccacggggugacgagcgccccggacacccgccccgcccccggcagcaccgcgcccccggcccacggggucaccuccgcccccgacacgcggcccgcccccggcagcaccgccccgcccgcgcacggcgugaccuccgcccccgacacccgccccgccccggggagcaccgccccccccgcgcacggcgugacguccgccccggacacccgccccgcccccgggagcaccgcccccccggcccacggcgucaccuccgcgcccgacacgcggcccgcccccgggagcaccgccccgcccgcccacggcgugaccuccgcccccgacacccgccccgcgccgggcagcacggccccccccgcccacggggugaccuccgcccccgacacccggccggcccccggcagcaccgcgccccccgcccacggggucacguccgccccggacacccgccccgcccccggcagcaccgcgcccccggcccacggggugaccuccgcccccgacacgcggcccgccccgggcagcaccgccccccccgcgcacggcgugaccuccgcccccgacacccgcccggcccccgggagcacggccccccccgcccacggcgucaccuccgcgccggacacccggcccgcccccgggagcaccgcccccccggcccacggcgugacgagcgcccccgacacccgccccgcgcccggguccaccgccccgcccgcccacggcgugaccagcgcccccgacacgcggcccgcgccgggcuccaccgccccccccgcccacggggucaccagcgcccccgacacccgcccggcccccggcuccacggcgccccccgcccacggggugaccagcgccccggacacccggcccgcccccggcuccaccgccccgcccgcgcacggcgugacgagcgcccccgacacccgccccgccccgggguccaccgccccccccgcccacggcgucaccagcgcgcccgacacccggccggcccccggguccacggccccccccgcccacggcgugaccagcgccccggacacccgccccgcgcccggguccaccgcccccccggcccacggcgugacgagcgcccccgacacccggcccgcgcccggcuccaccgccccgcccgcccacggggucaccagcgcccccgacacgcgccccgccccgggcuccaccgcgccccccgcccacggggugaccagcgcccccgacacccggccggcccccggcuccacggcccccccggcgcacggggugaccagcgcccccgacacccgccccgcccccggcagcaccgccccgcccgcccacggcgucacguccgcgcccgacaaccggcccgcccuggggagcaccgccccgcccgugcacaacgugaccuccgccagcggcuccgcgagcggguccgccagcacccucguccacaacggcacguccgcccgcgccaccaccacccccgccagcaaguccacgcccuucagcaucccgucccaccacagcgacacccccaccacccuggcgucccacagcacgaagaccgacgccuccagcacccaccacuccagcgugcccccccugaccagcuccaaccacagcacguccccgcagcucagcaccgggguguccuucuucuuccugagcuuccacaucuccaaccugcaguucaacagcucccucgaggaccccagcaccgacuacuaccaggagcugcagcgcgacaucuccgagauguuccugcagaucuacaagcagggcggcuuccucgggcugagcaacaucaaguuccggcccggcuccgucguggugcagcugacccucgccuuccgcgaggggacgaucaacguccacgacguggagacccaguucaaccaguacaagaccgaggccgccagccgguacaaccugaccaucuccgacgugagcgucuccgacgugcccuucccguucagcgcgcaguccggcgccggcgugcccggguggggcaucgcccugcucguccuggugugcgugcuggucgcccucgccaucguguaccugaucgcgcuggccgugugccagugccgccggaagaacuacgggcagcucgacaucuuccccgcccgcgacacguaccaccccaugagcgaguacccgaccuaccacacccacggccgguacgucccccccagcuccaccgaccgcagccccuacgagaagguguccgccgggaacggcggcagcucccugagcuacaccaacccggcgguggccgccacguccgccaaccug

SEQ ID NO: 76527 - RNA, 1260 nt, Artificial Sequence
  Q13641 TPBG
augcccggcgggugcagccgcggcccggccgccggggacggccggcugcgccucgcgcggcuggcccuggugcuccuggggugggucuccagcuccagccccaccuccagcgccuccagcuucuccagcuccgcccccuuccuggccagcgcgguguccgcccagcccccgcuccccgaccagugccccgcccugugcgagugcagcgaggccgcgcgcaccgugaagugcgucaaccggaaccugacggaggugcccaccgaccucccggccuacgugcgcaaccuguuccugaccggcaaccagcucgccguccugcccgccggcgccuucgcgcggcgccccccccuggccgagcucgccgcccugaaccuguccgggagccggcucgacgaggugcgcgccggcgcguucgagcaccugccgucccugcggcagcucgaccugagccacaacccccuggccgaccucucccccuucgccuucagcgggagcaacgccuccgugagcgcccccuccccgcuggucgagcugauccucaaccacaucgugccccccgaggacgagcgccagaaccggagcuucgagggcaugguggucgcggcccugcuggccgggcgcgcccuccagggccugcggcgccuggagcucgccuccaaccacuuccuguaccugccccgggacgugcucgcgcagcugccgagccugcgccaccucgaccuguccaacaacagccuggugucccucaccuacgucagcuuccggaaccugacgcaccuggagucccuccaccuggaggacaacgcccugaaggugcuccacaacggcacccuggccgagcugcaggggcugccccacauccgcguguuccucgacaacaaccccugggucugcgacugccacauggccgacauggugaccuggcugaaggagaccgaggugguccagggcaaggaccggcugacgugcgcguaccccgagaagaugcgcaaccgcgugcuccuggagcugaacagcgccgaccucgacugcgacccgauccugccccccucccugcagaccagcuacguguuccucgggaucguccuggcccugaucggcgccaucuuccuccuggugcuguaccucaaccggaagggcaucaagaaguggaugcacaacauccgcgacgccugccgggaccacauggagggguaccacuaccgcuacgagaucaacgcggacccccggcugaccaaccuguccagcaacuccgacguc

SEQ ID NO: 76528 - RNA, 3765 nt, Artificial Sequence
  P04626 ERBB2
auggagcuggccgcccucugccgcuggggccugcugcucgcgcugcugcccccgggggccgccagcacccaggugugcaccggcacggacaugaagcuccggcugcccgccucccccgagacccaccuggacaugcuccgccaccuguaccaggggugccaggucgugcagggcaaccuggagcucaccuaccugcccaccaacgccagccuguccuuccuccaggacauccaggaggugcagggguacguccugaucgcgcacaaccaggugcggcaggugccgcugcagcgccuccggaucguccgcggcacgcagcuguucgaggacaacuacgcccuggccgugcucgacaacggcgacccccugaacaacaccacccccgugaccggggccagccccggcgggcugcgggagcuccagcugcgcucccugacggagauccucaagggcgggguccugauccagcggaacccgcagcugugcuaccaggacaccauccucuggaaggacaucuuccacaagaacaaccagcuggcgcugacccucaucgacaccaaccgcagccgggccugccaccccugcucccccaugugcaagggcagccgcugcuggggcgaguccagcgaggacugccagucccugacgcggaccgugugcgccgggggcugcgcccgcugcaaggggccccugccgaccgacugcugccacgagcagugcgccgcgggcugcaccggccccaagcacagcgacugccucgccugccugcacuucaaccacuccgggaucugcgagcugcacugccccgcccucgugacguacaacaccgacaccuucgagagcaugcccaacccggagggccgguacaccuucggggccuccugcgucacggccugccccuacaacuaccugagcaccgacgugggcuccugcacccuggugugcccccuccacaaccaggaggucaccgcggaggacgggacgcagcgcugcgagaagugcagcaagcccugcgcccgggugugcuacggccugggcauggagcaccugcgcgaggugcgggccgucaccuccgccaacauccaggaguucgccgggugcaagaagaucuucggcagccucgcguuccugccggagagcuucgacggggaccccgccuccaacaccgccccccugcagcccgagcagcuccagguguucgagacccuggaggagaucacgggcuaccuguacaucagcgccuggccggacucccugcccgaccucagcguguuccagaaccugcaggucauccgcgggcggauccugcacaacggcgccuacucccucacccugcagggccuggggaucagcuggcucggccugcgcucccugcgcgagcucgggagcggccuggcgcugauccaccacaacacccaccucugcuucgugcacaccgugcccugggaccagcuguuccggaacccccaccaggcccugcuccacacggccaaccgcccggaggacgagugcgucggggagggccuggccugccaccagcugugcgcgcggggccacugcugggggcccggccccacccagugcgugaacugcucccaguuccuccgcgggcaggagugcgucgaggagugccgggugcugcagggccugccgcgcgaguacgugaacgcccggcacugccuccccugccaccccgagugccagccccagaacggcagcgucaccugcuucgggccggaggccgaccagugcguggccugcgcccacuacaaggacccccccuucugcguggcgcgcugccccuccggcgucaagccggaccugagcuacaugcccaucuggaaguuccccgacgaggagggggccugccagcccugcccgaucaacugcacccacuccugcguggaccuggacgacaagggcugccccgccgagcagcgggccagcccccucacguccaucaucagcgccguggucgggauccugcugguggugguccucggcgugguguucggcauccugaucaagcgccggcagcagaagauccgcaaguacaccaugcggcgccugcuccaggagaccgagcuggucgagccccugaccccguccggggcgaugcccaaccaggcccagaugcggauccucaaggagaccgagcugcgcaaggugaaggugcugggcagcggggccuucggcacggucuacaaggggaucuggauccccgacggcgagaacgugaagauccccguggccaucaagguccuccgggagaacaccuccccgaaggccaacaaggagauccuggacgaggcguacgugauggccggcguggggagccccuacgucagccgccugcucggcaucugccugaccuccaccgugcagcuggugacgcagcucaugcccuacgggugccugcuggaccacguccgggagaaccgcggccgccucgggagccaggaccugcugaacuggugcaugcagaucgccaagggcauguccuaccucgaggacgugcggcuggugcaccgcgaccuggccgcgcggaacguccucgugaagagccccaaccacgugaagaucaccgacuucggccuggcccgccugcucgacaucgacgagaccgaguaccacgccgacgggggcaaggucccgaucaaguggauggcccuggaguccauccugcggcgccgguucacccaccagagcgacgugugguccuacggggugacggucugggagcucaugaccuucggcgccaagcccuacgacgggauccccgcgcgcgagaucccggaccugcuggagaagggcgagcggcucccccagccccccaucugcaccaucgacguguacaugaucauggugaagugcuggaugaucgacagcgagugccgcccgcgguuccgcgagcuggucuccgaguucagccggauggcccgcgacccccagcgguucguggugauccagaacgaggaccugggccccgccuccccccucgacagcaccuucuaccgcucccugcuggaggacgacgacaugggggaccucgucgacgccgaggaguaccuggugccgcagcagggcuucuucugccccgaccccgcccccggggcgggcggcauggugcaccaccggcaccgcagcuccagcacgcgguccgggggcggggaccugacccucggccuggagccgagcgaggaggaggccccccgcagcccccuggcccccuccgagggggccggcagcgacgucuucgacggcgaccucgggaugggcgccgcgaaggggcugcagucccugccgacccacgaccccagcccccuccagcgguacuccgaggaccccaccgugccgcugcccagcgagacggacggcuacguggccccccugaccugcuccccccagccggaguacgucaaccagcccgacgugcgcccccagcccccgagcccccgcgaggggccccucccggccgcccggcccgcgggcgccacccuggagcgccccaagacccugucccccggcaagaacgggguggucaaggacguguucgccuucggcggggccgucgagaacccggaguaccucacgccccagggcggggccgcgccccagccccacccgccccccgccuucagccccgccuucgacaaccuguacuacugggaccaggacccgcccgagcggggcgccccccccuccaccuucaagggcaccccgaccgccgagaaccccgaguaccuggggcucgacgugcccgug

SEQ ID NO: 76529 - RNA, 942 nt, Artificial Sequence
  P43357 MAGA3
augccccuggagcagcgcagccagcacugcaagccggaggagggccucgaggcccggggggaggcccugggccuggugggggcgcaggcccccgccaccgaggagcaggaggccgccuccagcuccagcacccucgucgaggugacgcugggcgaggugcccgcggccgagucccccgacccgccccagagcccccagggggccuccagccugcccaccaccaugaacuacccgcucuggucccagagcuacgaggacuccagcaaccaggaggaggagggccccuccaccuuccccgaccuggagagcgaguuccaggccgcgcugucccgcaaggucgccgagcucgugcacuuccugcugcucaaguaccgggcccgcgagcccgugacgaaggccgagaugcugggcagcgucguggggaacuggcaguacuucuucccggugaucuucuccaaggccagcuccagccugcagcucgucuucggcaucgagcugauggagguggaccccaucgggcaccuguacaucuucgcgaccugccucggccugagcuacgacgggcugcucggcgacaaccagaucaugcccaaggccggccugcugaucaucgugcucgccaucaucgcccgggagggggacugcgcccccgaggagaagaucugggaggagcuguccguccuggagguguucgagggccgcgaggacagcauccucggggacccgaagaagcugcugacccagcacuucgugcaggagaacuaccucgaguaccggcagguccccggcuccgaccccgcgugcuacgaguuccuguggggcccccgcgcccugguggagaccagcuacgugaagguccuccaccacauggugaagaucuccgggggcccgcacaucagcuaccccccccugcacgagugggugcugcgggagggggaggag

SEQ ID NO: 76530 - RNA, 495 nt, Artificial Sequence
  Q17RY6 LY6K
auggcccugcucgcccugcugcucguggucgcgcugccccgcguguggaccgacgccaaccugaccgcccggcagcgcgacccggaggacagccagcggacggacgagggcgacaaccgcguguggugccacgucugcgagcgggagaacaccuucgagugccagaacccccgccggugcaaguggaccgagcccuacugcgugaucgccgccgugaagaucuucccccgcuucuucauggucgcgaagcagugcuccgccgggugcgccgccauggagcggccgaagcccgaggagaagcgcuuccuccuggaggagcccaugcccuucuucuaccugaagugcugcaagauccgguacugcaaccucgagggcccgcccaucaacagcuccguguucaaggaguacgcggggagcaugggcgaguccugcgggggccuguggcuggccauccuccugcugcucgccagcaucgccgccggccugucccugagc

SEQ ID NO: 76531 - RNA, 1032 nt, Artificial Sequence
  P40199 CEAM6
augggccccccgagcgccccccccugccgccugcacgugcccuggaaggagguccuccugaccgccucccugcucaccuucuggaacccgcccacgaccgcgaagcugaccaucgagagcacccccuucaacguggccgaggggaaggaggugcugcuccuggcccacaaccugccccagaaccggaucggcuacuccugguacaagggggagcgcgucgacggcaacagccucaucgugggguacgugaucggcacgcagcaggccaccccgggccccgccuacuccgggcgggagaccaucuaccccaacgcgagccugcugauccagaacgucacccagaacgacacgggcuucuacacccuccaggugaucaaguccgaccuggugaacgaggaggccaccgggcaguuccacgucuaccccgagcugccgaagcccagcaucuccagcaacaacuccaaccccguggaggacaaggacgccguggccuucaccugcgagcccgagguccagaacacgaccuaccucuggugggugaacggccagagccugccgguguccccccgccugcagcucagcaacgggaacaugacccugacccugcucuccgucaagcggaacgacgcgggcagcuacgagugcgagauccagaaccccgccuccgccaaccgcagcgaccccgugacgcugaacgugcuguacggcccggacgggcccaccaucucccccagcaaggccaacuaccggcccggcgagaaccucaaccugagcugccacgccgcguccaacccgcccgcccaguacagcugguucaucaacgggaccuuccagcaguccacccaggagcuguucauccccaacaucacggucaacaacagcggcuccuacaugugccaggcccacaacagcgccaccggccucaaccgcaccaccgugacgaugaucaccguguccgggagcgcccccguccuguccgcgguggccaccgugggcaucaccaucgggguccuggcccggguggcccucauc

SEQ ID NO: 76532 - RNA, 1347 nt, Artificial Sequence
  P19544 WT1
augggcagcgacgugcgcgaccugaacgcccuccugcccgccgucccgucccuggggggcgggggcgggugcgcgcuccccgugagcggcgccgcccagugggcccccgugcuggacuucgcccccccgggcgcguccgccuacgggagccugggcgggcccgccccccccccggcccccccccccccgcccccccccccgccccacuccuucaucaagcaggagcccagcuggggcggggcggagccccacgaggagcagugccucuccgccuucaccguccacuucagcggccaguucaccggcacggccggggccugccgguacggcccguucgggcccccccccccgucccaggccagcuccggccaggcgcgcauguuccccaacgcccccuaccugcccagcugccuggagucccagccggccauccggaaccagggcuacagcaccgugaccuucgacgggacccccuccuacggccacacgcccagccaccacgccgcccaguucccgaaccacuccuucaagcacgaggaccccauggggcagcagggcagccucggggagcagcaguacuccgugccccccccggucuacggcugccacacccccaccgacagcugcaccggcagccaggcgcugcugcuccgcacgcccuacuccagcgacaaccuguaccagaugaccucccagcuggagugcaugaccuggaaccagaugaaccucggggccacccugaagggcguggccgccgggagcuccagcuccgugaaguggacggagggccagagcaaccacuccaccggguacgagagcgacaaccacaccacccccauccugugcggcgcccaguaccggauccacacgcacggcgucuuccgcgggauccaggacgugcggcgcgugccgggcgucgcgcccacccucgugcgguccgccagcgagaccuccgagaagcgccccuucaugugcgccuaccccgggugcaacaagcgguacuucaagcugagccaccugcagaugcacucccgcaagcacaccggcgagaagccguaccagugcgacuucaaggacugcgagcggcgcuucagccgguccgaccagcucaagcgccaccagcggcgccacacgggggugaagcccuuccagugcaagaccugccagcggaaguucagccgcuccgaccaccugaagacccacacccggacgcacaccggcaagaccagcgagaagcccuucagcugccgcuggcccuccugccagaagaaguucgcccgcagcgacgagcugguccggcaccacaacaugcaccagcgcaacaugaccaagcuccagcuggcccug

SEQ ID NO: 76533 - RNA, 2106 nt, Artificial Sequence
  P06731 CEAM5
auggagagccccuccgccccgccccaccgcuggugcauccccuggcagcggcugcuccugaccgccagccugcucaccuucuggaaccccccgacgaccgcgaagcugaccaucgaguccacccccuucaacguggccgagggcaaggagguccugcuccuggugcacaaccugccccagcaccucuucggguacagcugguacaagggcgagcgcguggacgggaaccggcagaucaucggcuacgucaucgggacgcagcaggccacccccggcccggccuacuccggccgcgagaucaucuaccccaacgccagccugcugauccagaacaucauccagaacgacaccggguucuacacccuccacgugaucaaguccgaccuggugaacgaggaggcgacgggccaguuccgggucuaccccgagcugcccaagccgagcaucuccagcaacaacuccaagcccguggaggacaaggacgccguggccuucaccugcgagcccgagacccaggacgccaccuaccucuggugggucaacaaccagagccugcccguguccccgcgccugcagcucagcaacgggaaccggacgcugacccuguucaacgugacccgcaacgacaccgcguccuacaagugcgagacgcagaaccccgucagcgcccggcgcuccgacagcgugauccucaacgugcuguacggccccgacgcccccaccaucuccccgcugaacaccagcuaccggagcggggagaaccucaaccuguccugccacgccgccagcaacccccccgcgcaguacuccugguucgucaacggcaccuuccagcagagcacgcaggagcuguucauccccaacaucaccgugaacaacuccggcagcuacaccugccaggcccacaacuccgacaccgggcucaaccgcacgaccgugaccaccaucacggucuacgccgagccgcccaagcccuucaucaccagcaacaacuccaaccccguggaggacgaggacgccguggcccugaccugcgagccggagauccagaacaccacguaccuguggugggucaacaaccagagccuccccguguccccccggcugcagcugagcaacgacaaccgcacccucacccugcuguccgugacccggaacgacgucggcccguacgagugcgggauccagaacaagcucagcguggaccacuccgaccccgucauccugaacgugcuguacggccccgacgaccccacgaucagcccguccuacaccuacuaccgccccggcgugaaccucagccuguccugccacgcggccagcaacccccccgcccaguacagcuggcugaucgacgggaacauccagcagcacacccaggagcucuucaucuccaacaucaccgagaagaacagcggccuguacaccugccaggccaacaacuccgccagcgggcacucccggacgaccgucaagaccaucaccgugagcgcggagcugccgaagcccuccaucagcuccaacaacagcaagcccguggaggacaaggacgccgucgccuucacgugcgagcccgaggcccagaacaccaccuaccucuggugggugaacggccagucccugccggugagcccccgccugcagcucuccaacgggaaccggacccugacgcuguucaacgucacccgcaacgacgcccgggcguacgugugcggcauccagaacagcguguccgccaaccgcagcgaccccgucacccuggacgugcucuacggccccgacaccccgaucaucuccccccccgacagcagcuaccuguccggggccaaccugaaccucagcugccacuccgccagcaaccccuccccgcaguacagcuggcgcaucaacggcaucccccagcagcacacgcaggugcuguucaucgcgaagaucacccccaacaacaacgggaccuacgccugcuucgucuccaaccuggccaccggccggaacaacagcaucgugaaguccaucacggugagcgccuccgggaccagccccggccucuccgccggcgcgaccgucgggaucaugaucggcgugcuggugggggucgcccugauc

SEQ ID NO: 76534 - RNA, 2175 nt, Artificial Sequence
  Q99661 KIF2C
auggccauggacagcucccugcaggcccgccucuuccccggccuggcgaucaagauccagcggagcaacgggcugauccacuccgccaacgugcgcaccgucaaccucgagaagagcugcguguccguggagugggccgagggcggggccaccaagggcaaggagaucgacuucgacgacgucgccgcgaucaacccggagcugcugcagcuccugccccugcaccccaaggacaaccucccccugcaggagaacgugacgauccagaagcagaagcggcgcagcgugaacuccaagaucccggcccccaaggagagccugcggucccgcagcacccggauguccaccgucagcgagcuccgcaucaccgcccaggagaacgacauggagguggagcugcccgccgcggccaacucccggaagcaguucagcgugcccccggcccccacgcgccccuccugccccgccgucgccgagaucccgcugcggauggugagcgaggagauggaggagcaggugcacuccauccgcgggagcuccagcgcgaaccccgucaacagcgugcggcgcaaguccugccucgugaaggaggucgagaagaugaagaacaagcgggaggagaagaaggcccagaacagcgagaugcgcaugaagcgggcccaggaguacgacuccagcuuccccaacugggaguucgcccgcaugaucaaggaguuccgggccacccuggagugccacccccugaccaugaccgacccgaucgaggagcaccgcaucugcgugugcgugcggaagcgcccccucaacaagcaggagcuggcgaagaaggagaucgacgucaucuccauccccagcaagugccugcuccuggugcacgagcccaagcugaagguggaccucacgaaguaccuggagaaccaggccuucugcuucgacuucgccuucgacgagaccgccuccaacgaggucguguaccgcuucaccgcccggccgcuggugcagaccaucuucgagggcggcaaggcgacgugcuucgccuacgggcagaccggcagcgggaagacccacaccaugggcggggaccucuccggcaaggcccagaacgccagcaagggcaucuacgccauggcgucccgcgacgucuuccugcugaagaaccagcccugcuaccggaagcucgggcuggagguguacgucacguucuucgagaucuacaacggcaagcuguucgaccuccugaacaagaaggccaagcugcgcgugcucgaggacgggaagcagcaggugcaggucgugggccugcaggagcaccuggugaacagcgccgacgacgucaucaagaugaucgacaugggcuccgccugccggaccagcgggcagaccuucgcgaacuccaacagcucccgcagccacgccugcuuccagaucauccuccgggccaagggccgcaugcacgggaaguucucccugguggaccuggccggcaacgagcggggggccgacaccagcagcgcggaccgccagacgcggauggagggcgccgagaucaacaagucccuccuggcccugaaggagugcauccgcgcccucggccagaacaaggcccacacccccuuccgggagagcaagcugacccaggugcugcgcgacuccuucaucggggagaacagccggaccugcaugaucgcgacgaucucccccggcaucagcuccugcgaguacacccucaacacccugcgcuacgccgaccgggucaaggagcugagcccgcacuccgggcccagcggcgagcagcugauccagauggagaccgaggagauggaggccugcuccaacggggcccucauccccggcaaccugagcaaggaggaggaggagcuguccagccagauguccagcuucaacgaggccaugacgcagauccgcgagcucgaggagaaggcgauggaggagcugaaggagaucauccagcagggccccgacuggcuggagcucuccgagaugaccgagcagccggacuacgaccuggagaccuucgugaacaaggccgagagcgcccuggcccagcaggcgaagcacuucagcgcccuccgggacgugaucaaggcccugcgccuggccaugcagcucgaggagcaggccucccgccagaucagcuccaagaagcggccccag

SEQ ID NO: 76535 - RNA, 339 nt, Artificial Sequence
  Q5H943 KKLC1
augaacuucuaccugcuccuggccagcuccauccugugcgcccucaucguguucuggaaguaccgccgguuccagcgcaacaccggcgagaugagcuccaacagcaccgcgcuggcccugguccggcccuccagcuccgggcucaucaacagcaacacggacaacaaccuggccguguacgaccugucccgcgacauccucaacaacuucccgcacagcaucgcccggcagaagcgcauccuggugaaccuguccauggucgagaacaagcucguggagcuggagcacacccugcucagcaagggcuuccggggggccuccccccaccgcaagagcacc

SEQ ID NO: 76536 - RNA, 303 nt, Artificial Sequence
  P01350 GAST
augcagcgccugugcguguacguccucaucuucgcccuggcccuggcggccuucagcgaggccuccuggaagccccggagccagcagccggacgccccccucggcaccggggccaaccgcgaccuggagcugcccuggcucgagcagcagggccccgcgucccaccaccggcgccagcuggggccgcagggccccccccaccugguggccgaccccagcaagaagcaggggccguggcucgaggaggaggaggaggccuacggcuggauggacuucggccggcgcuccgccgaggacgagaac

SEQ ID NO: 76537 - RNA, 4068 nt, Artificial Sequence
  P35968 VGFR2
augcagagcaaggugcugcucgccgucgcccuguggcugugcguggagacccgcgcggccuccgugggccuccccagcgucucccuggaccugccgcggcucagcauccagaaggacauccugaccaucaaggccaacacgacccugcagaucaccugccgcgggcagcgggaccucgacuggcuguggcccaacaaccaguccggcagcgagcagcgcguggaggugaccgagugcuccgacgggcuguucugcaagacgcucaccauccccaaggucaucggcaacgacaccggggccuacaagugcuucuaccgggagaccgaccuggccagcgugaucuacguguacguccaggacuaccgcucccccuucaucgcgagcguguccgaccagcacggcguggucuacaucacggagaacaagaacaagaccguggugaucccgugccugggcagcaucuccaaccucaacgucagccugugcgcccgguaccccgagaagcgcuucgugcccgacgggaaccggaucuccugggacagcaagaagggcuucaccauccccuccuacaugaucagcuacgccgggaugguguucugcgaggccaagaucaacgacgaguccuaccagagcaucauguacaucgucgugguggucggcuaccgcaucuacgacguggugcugagcccgucccacgggaucgagcucagcgucggcgagaagcuggugcugaacugcaccgcgcggacggagcucaacgucggcaucgacuucaacugggaguaccccuccagcaagcaccagcacaagaagcuggugaaccgcgaccugaagacccaguccgggagcgagaugaagaaguuccucuccacccugaccaucgacggcgugacgcggagcgaccaggggcuguacaccugcgccgccuccagcggccucaugaccaagaagaacuccaccuucguccgcgugcacgagaagcccuucguggccuucggcagcgggauggagucccuggucgaggccacggugggcgagcgggugcgcauccccgcgaaguaccugggguacccgccccccgagaucaagugguacaagaacggcaucccccucgagagcaaccacaccaucaaggccgggcacguccugaccaucauggagguguccgagcgggacaccggcaacuacacggugauccugaccaacccgaucagcaaggagaagcagucccacgucgugagccucguggucuacgugcccccccagaucggcgagaagucccugaucagccccguggacagcuaccaguacgggaccacccagacgcugaccugcaccgucuacgccaucccgcccccccaccacauccacugguacuggcagcucgaggaggagugcgccaacgagcccucccaggccgugagcgugaccaacccguaccccugcgaggaguggcgcuccgucgaggacuuccagggcgggaacaagaucgaggugaacaagaaccaguucgcgcugaucgagggcaagaacaagacggugagcacccuggucauccaggccgccaacguguccgcccucuacaagugcgaggccgugaacaaggucgggcggggcgagcgcgugaucagcuuccacgugacccggggccccgagaucacccugcagcccgacaugcagccgacggagcaggaguccgucagccuguggugcaccgcggaccgcuccaccuucgagaaccucaccugguacaagcuggggccccagccccugccgauccacgugggcgagcuccccacccccgugugcaagaaccuggacacgcuguggaagcucaacgccaccauguucagcaacuccaccaacgacauccugaucauggagcugaagaacgccagccugcaggaccagggggacuacgucugccucgcccaggaccgcaagaccaagaagcggcacugcguggugcgccagcugacgguccuggagcggguggcccccaccaucaccggcaaccucgagaaccagaccacguccaucggggagagcaucgagguguccugcaccgcgagcggcaacccgcccccccagaucaugugguucaaggacaacgagacccuggucgaggacuccggcaucgugcugaaggacgggaaccgcaaccucaccauccggcgcgugcggaaggaggacgagggccuguacacgugccaggccugcagcguccuggggugcgccaagguggaggccuucuucaucaucgagggcgcgcaggagaagaccaaccucgagaucaucauccuggugggcaccgccgucaucgccauguucuucuggcugcuccuggugaucauccugcgcaccgugaagcgggccaacgggggcgagcucaagacgggguaccugagcaucgucauggaccccgacgagcugccgcucgacgagcacugcgagcgccugcccuacgacgccuccaagugggaguucccccgggaccgccugaagcucggcaagccccuggggcggggcgcguucggccaggugaucgaggccgacgccuucgggaucgacaagaccgccaccugccgcaccguggccgucaagaugcugaaggagggcgcgacgcacagcgagcaccgggcccucauguccgagcugaagauccugauccacaucgggcaccaccucaacguggucaaccugcugggcgccugcaccaagccggggggcccccucauggugaucguggaguucugcaaguucggcaaccugagcaccuaccugcgcuccaagcggaacgaguucguccccuacaagaccaagggggcccgcuuccggcagggcaaggacuacgugggggccauccccguggaccucaagcgccgccuggacagcaucacguccagccaguccagcgcguccagcggcuucgucgaggagaagucccugagcgacguggaggaggaggaggccccggaggaccucuacaaggacuuccugacccuggagcaccucaucugcuacuccuuccagguggccaaggggauggaguuccuggccagccggaagugcauccaccgcgaccuggcggcccggaacauccuccuguccgagaagaacgucgugaagaucugcgacuucggccuggcccgcgacaucuacaaggaccccgacuacgugcggaagggcgacgcccgccucccccugaaguggauggcccccgagaccaucuucgaccgggucuacaccauccagagcgacgugugguccuucggggugcugcucugggagaucuucagccugggcgcgagcccguaccccggggucaagaucgacgaggaguucugccgccggcugaaggagggcacgcgcaugcgggcccccgacuacaccacccccgagauguaccagaccaugcucgacugcuggcacggggagccgucccagcgccccacguucagcgagcugguggagcaccugggcaaccuccugcaggccaacgcccagcaggacggcaaggacuacaucgugcugcccaucuccgagacccucagcauggaggaggacuccgggcugagccugccgaccucccccgucagcugcauggaggaggaggaggugugcgaccccaaguuccacuacgacaacaccgccggcaucucccaguaccuccagaacagcaagcggaagucccgccccgugagcgucaagacguucgaggacaucccgcuggaggagcccgaggugaaggugauccccgacgacaaccagaccgacuccgggaugguccuggcgagcgaggagcucaagacccuggaggaccggaccaagcugucccccagcuucggcggcauggugccguccaagagccgcgaguccguggccagcgaggggagcaaccagaccuccggcuaccagagcggguaccacuccgacgacacggacaccaccgucuacagcuccgaggaggccgagcuccugaagcugaucgagaucggcgugcagaccgggagcacggcccagauccuccagcccgacuccggcaccacccugagcuccccccccgug

SEQ ID NO: 76538 - RNA, 801 nt, Artificial Sequence
  P09237 MMP7
augcgccugaccgugcucugcgccgucugccugcugcccggcagccucgcccugccgcugccccaggaggcggggggcauguccgagcuccagugggagcaggcccaggacuaccugaagcgguucuaccuguacgacagcgagaccaagaacgccaacucccucgaggccaagcugaaggagaugcagaaguucuucgggcugcccaucacgggcaugcucaacagccgcgugaucgagaucaugcagaagccccggugcggggugccggacgucgccgaguacucccuguuccccaacagccccaaguggaccuccaagguggugaccuaccgcaucgucagcuacacccgggaccugccccacaucacgguggaccgccucguguccaaggcgcugaacauguggggcaaggagaucccgcugcacuuccggaaggucguguggggcaccgccgacaucaugaucggguucgcccgcggcgcccacggggacagcuaccccuucgacggccccgggaacacccucgcgcacgccuucgcccccggcaccggccuggggggcgacgcccacuucgacgaggacgagcgguggacggacggguccagccugggcaucaacuuccucuacgccgcgacccacgagcugggccacucccuggggaugggccacagcuccgacccgaacgccgugauguaccccaccuacgggaacggcgacccccagaacuucaagcucagccaggacgacaucaaggggauccagaagcuguacggcaagcgcuccaacagccggaagaag

SEQ ID NO: 76539 - RNA, 5460 nt, Artificial Sequence
  Q96Q89 KI20B
auggagagcaacuucaaccaggagggcgugccccgcccguccuacgucuucagcgccgaccccaucgcccggcccuccgagaucaacuucgacgggaucaagcuggaccucagccacgaguucucccugguggcgcccaacaccgaggccaacagcuucgaguccaaggacuaccugcaggugugccuccgcauccggccguucacccagagcgagaaggagcuggaguccgagggcugcguccacauccuggacagccagacgguggugcucaaggagccccagugcauccuggggcgccuguccgagaagagcuccggccagauggcccagaaguucagcuucuccaaggucuucgggcccgccaccacccagaaggaguucuuccagggcugcaucaugcagcccgugaaggaccuccugaagggccagagccggcugaucuucaccuacgggcucacgaacuccggcaagaccuacaccuuccaggggaccgaggagaacaucggcauccugccgcgcacgcugaacgugcucuucgacagccugcaggagcggcuguacaccaagaugaaccucaagccccaccgcucccgggaguaccugcgccugagcagcgagcaggagaaggaggagaucgccuccaagagcgcgcuccugcggcagaucaaggaggucaccgugcacaacgacuccgacgacacccuguacgggagccucacgaacucccugaacaucagcgaguucgaggaguccaucaaggacuacgagcaggccaaccugaacauggccaacagcaucaaguucuccgugugggucagcuucuucgagaucuacaacgaguacaucuacgaccucuucgugcccguguccagcaaguuccagaagcgcaagaugcugcggcugucccaggacgucaagggcuacagcuucaucaaggaccuccaguggauccagguguccgacagcaaggaggccuaccgccugcugaagcucggcaucaagcaccaguccguggcguucaccaagcugaacaacgccagcucccggagccacagcaucuucaccgucaagauccugcagaucgaggacuccgagaugagccgcgugauccggguguccgagcucagccugugcgaccuggccggguccgagcgcaccaugaagacgcagaacgagggcgagcggcuccgcgagaccgggaacaucaacaccagccugcugacccucggcaagugcaucaacguccugaagaacuccgagaagagcaaguuccagcagcacgugcccuuccgggaguccaagcugacgcacuacuuccagagcuucuucaacggcaaggggaagaucugcaugaucgugaacaucucccagugcuaccucgccuacgacgagacccugaacguccugaaguucagcgccaucgcgcagaaggugugcgucccggacacccucaacuccagccaggagaagcuguucggccccgugaaguccagccaggacgugucccuggacagcaacagcaacuccaagauccugaacgucaagcgcgccaccaucagcugggagaacucccucgaggaccugauggaggacgaggaccugguggaggagcucgagaacgccgaggagacgcagaacguggagaccaagcugcuggacgaggaccucgacaagacccuggaggagaacaaggccuucaucagccacgaggagaagcgcaagcugcucgaccugaucgaggaccugaagaagaagcucaucaacgagaagaaggagaagcugacccuggaguucaagauccgggaggaggucacgcaggaguucacccaguacugggcccagcgcgaggcggacuucaaggagacccuccugcaggagcgggagauccuggaggagaacgccgagcgccggcucgccaucuucaaggaccugguggggaagugcgacacccgcgaggaggccgccaaggacaucugcgcgacgaagguggagaccgaggagacccacaacuacgucggcuucgaggacaucaucgacucccugcaggacaacguggccgacaucaagaagcaggccgagaucgcccaccucuacaucgccagccugcccgacccccaggaggcgaccgccugccuggagcucaaguucaaccagaucaaggccgagcuggccaagacgaagggggagcugaucaagaccaaggaggagcucaagaagcgggagaacgaguccgacagccugauccaggagcuggagaccuccaacaagaagaucaucacccagaaccagcgcaucaaggagcucaucaacaucaucgaccagaaggaggacaccaucaacgaguuccagaaccugaagagccacauggagaacacguucaagugcaacgacaaggcggacaccuccagccugaucaucaacaacaagcucaucugcaacgagaccguggaggucccgaaggacuccaagagcaagaucugcuccgagcggaagcgcgugaacgagaacgagcugcagcaggacgagccccccgccaagaagggcagcauccacguguccagcgccaucaccgaggaccagaagaaguccgaggagguccggcccaacaucgccgagaucgaggacauccgcgugcugcaggagaacaacgagggccuccgggccuuccugcugacgaucgagaacgagcucaagaacgagaaggaggagaaggcggagcugaacaagcagaucgugcacuuccagcaggagcugagccucagcgagaagaagaaccugacccuguccaaggagguccagcagauccagagcaacuacgacaucgccaucgccgagcuccacgugcagaaguccaagaaccaggagcaggaggagaagaucaugaagcugagcaacgagaucgagaccgccacccgcuccaucacgaacaacgugagccagaucaagcugaugcacaccaagaucgacgagcuccggacccuggacuccgucagccagaucuccaacaucgaccugcucaaccugcgcgaccugagcaacggguccgaggaggacaaccucccgaacacccagcuggaccugcucggcaacgacuaccuggugagcaagcaggugaaggaguaccggauccaggagcccaaccgcgagaacuccuuccacagcuccaucgaggccaucugggaggagugcaaggagaucgucaaggcgagcuccaagaagagccaccagaucgaggagcuggagcagcagaucgagaagcuccaggccgaggugaagggguacaaggacgagaacaaccggcugaaggagaaggagcacaagaaccaggacgaccugcucaaggagaaggagacgcugauccagcagcugaaggaggagcuccaggagaagaacgugacccuggacguccagauccagcacgugguggagggcaagcgcgcccuguccgagcucacccagggggucaccugcuacaaggccaagaucaaggagcuggagacgauccuggagacccagaagguggagugcagccacagcgccaagcucgagcaggacauccuggagaaggaguccaucauccugaagcucgagcgcaaccugaaggaguuccaggagcaccugcaggacagcgugaagaacaccaaggaccucaacgucaaggagcugaagcugaaggaggagaucacccagcucacgaacaaccugcaggacaugaagcaccugcuccagcugaaggaggaggaggaggagaccaaccggcaggagaccgagaagcugaaggaggagcucuccgcgagcuccgcccgcacccagaaccugaaggccgaccugcagcggaaggaggaggacuacgccgaccucaaggagaagcugacggacgcgaagaagcagaucaagcaggugcagaaggaggugagcgucaugcgcgacgaggacaagcugcuccggaucaagaucaacgagcuggagaagaagaagaaccagugcucccaggagcuggacaugaagcagcgcaccauccagcagcugaaggagcagcucaacaaccagaagguggaggaggccauccagcaguacgagcgggccugcaaggaccugaacgugaaggagaagaucaucgaggacaugcgcaugacccuggaggagcaggagcagacccaggucgagcaggaccaggugcucgaggccaagcuggaggagguggagcggcuggccacggagcucgagaaguggaaggagaagugcaacgaccuggagaccaagaacaaccagcgcagcaacaaggagcacgagaacaacaccgacguccugggcaagcucaccaaccugcaggacgagcugcaggaguccgagcagaaguacaacgcggaccggaagaaguggcucgaggagaagaugaugcugaucacgcaggccaaggaggccgagaacauccgcaacaaggagaugaagaaguacgccgaggaccgggagcgcuucuucaagcagcagaacgagauggagauccugaccgcccagcucaccgagaaggacagcgaccugcagaaguggcgggaggagcgcgaccagcugguggcggcccucgagauccagcugaaggcccugaucuccagcaacgugcagaaggacaacgagaucgagcagcucaagcggaucaucuccgagaccagcaagaucgagacgcagaucauggacaucaagcccaagcgcaucuccagcgccgaccccgacaagcugcagaccgagccgcuguccaccagcuucgagaucucccggaacaagaucgaggacggcagcgucgugcucgacagcugcgagguguccaccgagaacgaccagagcacccgcuuccccaagcccgagcuggagauccaguucacgccccugcagccgaacaagauggccgucaagcaccccgggugcaccacccccgugaccgugaagaucccgaaggcgcggaagcgcaaguccaacgagauggaggaggaccucgucaagugcgagaacaagaagaacgccacgccccgcaccaaccugaaguuccccaucagcgacgaccggaacuccagcgugaagaaggagcagaaggucgccauccgccccuccagcaagaagaccuacucccugcggagccaggccuccaucaucggcgugaaccucgcgaccaagaagaaggaggggacgcugcagaaguucggcgacuuccugcagcacagcccguccauccuccagagcaaggccaagaagaucaucgagaccauguccagcuccaagcugagcaacguggaggccuccaaggagaacgucagccagcccaagcgcgccaagcggaagcuguacaccagcgagaucuccagccccaucgacaucuccgggcaggugauccucauggaccagaagaugaaggagagcgaccaccagaucaucaagcgccggcugcgcaccaagacggccaag

SEQ ID NO: 76540 - RNA, 951 nt, Artificial Sequence
  P43358 MAGA4
augagcuccgagcagaagagccagcacugcaagcccgaggagggcguggaggcccaggaggaggcccuggggcucgucggcgcgcaggccccgaccaccgaggagcaggaggccgccguguccagcuccagcccccuggugcccgggacgcuggaggagguccccgccgcggaguccgccggcccgccccagagcccccagggggccuccgcccuccccaccaccaucagcuucaccugcuggcgccagccgaacgagggcuccagcucccaggaggaggagggccccagcacgucccccgacgcggagagccuguuccgggaggcccuguccaacaagguggacgagcucgcccacuuccugcugcgcaaguaccgggccaaggagcucgugaccaaggccgagaugcuggagcgcgucaucaagaacuacaagcggugcuuccccgugaucuucgggaaggcgagcgagucccugaagaugaucuucggcaucgacgugaaggaggucgacccggccagcaacaccuacacccucgugacgugccuggggcugagcuacgacggccuccuggggaacaaccagaucuuccccaagaccggccugcucaucaucgugcugggcaccaucgccauggagggggacuccgccagcgaggaggagaucugggaggagcugggcgucauggggguguacgacggccgcgagcacaccguguacggcgagccccggaagcuccugacgcaggacuggguccaggagaacuaccuggaguaccgccaggugcccggguccaacccggcccgguacgaguuccucuggggcccccgcgcgcuggccgagaccagcuacgugaagguccuggagcacguggugcgggucaacgcccgcgugcggaucgccuaccccucccuccgcgaggccgcgcugcuggaggaggaggagggggug

SEQ ID NO: 76541 - RNA, 927 nt, Artificial Sequence
  P43355 MAGA1
augagccuggagcagcgcucccuccacugcaagcccgaggaggcccuggaggcccagcaggaggcgcugggccucgugugcguccaggccgccaccagcuccagcuccccgcuggugcuggggacccucgaggaggugcccacggccggcagcaccgaccccccccaguccccgcagggggccagcgcguuccccaccaccaucaacuucacgcggcagcgccagcccuccgagggcagcuccagccgggaggaggaggggcccuccaccagcugcauccuggagucccuguuccgcgccgucaucaccaagaagguggccgaccucgugggcuuccugcugcucaaguaccgggcccgcgagccggucaccaaggcggagaugcuggagagcgugaucaagaacuacaagcacugcuuccccgagaucuucggcaaggccuccgagagccugcagcucguguucgggaucgacgucaaggaggccgaccccacgggccacuccuacgugcuggugaccugccuggggcucagcuacgacggccugcugggggacaaccagaucaugcccaagaccggcuuccucaucaucguccuggugaugaucgccauggagggcgggcacgccccggaggaggagaucugggaggagcugagcgugauggaggucuacgacggccgggagcacuccgcguacggggagccccgcaagcuccugacccaggaccuggugcaggagaaguaccucgaguaccggcaggugcccgacagcgaccccgcccgcuacgaguuccuguggggcccgcgggcccuggccgagacguccuacgucaaggugcucgaguacgugaucaaggucagcgcccgcgugcgguucuucuuccccucccugcgcgaggcggcccugcgggaggaggaggagggcgug

SEQ ID NO: 76542 - RNA, 3426 nt, Artificial Sequence
  O60732 MAGC1
augggcgacaaggacaugcccaccgccgggaugccgagccugcuccaguccagcuccgagagcccccaguccugccccgagggcgaggacagccaguccccccugcagaucccgcagagcucccccgagagcgacgacacccuguacccccuccaguccccccagagccgcuccgagggggaggacagcuccgacccgcugcagcggccccccgagggcaaggacagccaguccccccugcagaucccgcagagcucccccgagggggacgacacgcagagcccccuccagaacagccaguccagccccgagggcaaggacucccugagcccgcuggagaucucccagagcccccccgagggcgaggacgugcaguccccccuccagaacccggccagcuccuucuucagcuccgcgcugcugagcaucuuccaguccagccccgaguccacccagagccccuucgagggguucccccaguccguccuccagaucccggugagcgccgccuccagcagcacccugguguccaucuuccagagcucccccgagagcacccagucccccuucgagggcuucccccagagcccgcugcagauccccgucucccgcagcuucuccagcacgcuccuguccaucuuccagagcucccccgagcggacccagagcaccuucgagggguucgcccaguccccgcugcagauccccgugagccccuccagcagcuccacccuccugagccuguuccaguccuucagcgagcgcacgcaguccaccuucgagggcuucgcccagagcucccuccagauccccgugagcccguccuucagcuccacccuggucagccuguuccaguccagccccgagcggacccaguccacguucgagggguucccccagagcccccuccagaucccgguguccagcuccagcagcuccacccugcugagccucuuccaguccagccccgagcgcacccacuccaccuucgagggcuucccccagagccugcugcagauccccaugacguccagcuucuccagcacccuccuguccaucuuccagagcuccccggagagcgcgcaguccaccuucgagggcuucccccagagcccccugcagauccccggguccccgagcuucuccagcacccuccugagccuguuccaguccagccccgagcggacgcacuccaccuucgagggcuucccccagagcccccuccagaucccgaugaccuccagcuucuccagcacccugcuguccauccuccagagcucccccgagagcgcccaguccgccuucgagggguucccccagagcccccugcagaucccgguguccagcuccuucagcuacacgcugcucucccuguuccagagcagccccgagcgcacccacuccaccuucgagggcuucccccagagcccgcugcagauccccgucuccagcuccagcuccagcuccacccuccugagccuguuccaguccagccccgagugcacgcaguccaccuucgagggcuucccccagagcccgcuccagaucccccaguccccccccgagggggagaacacccacagcccgcugcagaucgugcccucccugcccgagugggaggacagccuguccccccacuacuucccgcagagccccccccagggcgaggacagccucuccccccacuacuucccgcagagccccccccagggggaggacucccugagcccccacuacuucccgcaguccccccagggcgaggacagccuguccccccacuacuucccccagagcccgccccagggggaggacuccaugagcccccucuacuucccccaguccccgcugcagggcgaggaguuccagagcucccugcagagccccguguccaucugcagcuccagcacccccuccagccucccgcagagcuuccccgaguccagccaguccccccccgagggcccgguccagagcccccugcacuccccccagagccccccggaggggaugcacucccagagcccccugcagucccccgagagcgcccccgagggcgaggacucccucagcccgcugcagaucccccaguccccccuggagggggaggacagccucuccagccugcacuucccccaguccccgcccgagugggaggacagccugagcccccuccacuucccccaguucccgccccagggcgaggacuuccaguccagccugcagucccccgugagcaucugcuccagcuccacgagccugucccucccccagagcuucccggaguccccccagagcccccccgaggggccggcgcaguccccccugcagcggcccgugagcuccuucuucagcuacacccuggccucccuccugcagagcucccacgagagcccgcagagcccccccgagggccccgcccaguccccgcugcagagccccgucuccagcuuccccuccagcaccuccagcucccucagccaguccagccccguguccagcuucccguccagcaccuccagcucccugagcaagagcucccccgagagcccccugcagucccccgugaucagcuucuccagcuccacgagccucuccccguucagcgaggaguccagcucccccgucgacgaguacaccagcuccagcgacacccugcuggaguccgacagccucaccgacuccgagagccugaucgagagcgagccccuguucaccuacacgcucgacgagaagguggacgagcuggcccgcuuccugcuccugaaguaccaggugaagcagcccaucaccaaggccgagaugcugaccaacgucaucucccgguacaccggcuacuucccggugaucuuccgcaaggcgcgggaguucaucgagauccucuucgggaucagccugcgcgagguggaccccgacgacuccuacgucuucgugaacacgcuggaccucaccagcgagggcugccuguccgacgagcaggggaugagccagaaccggcugcucauccugauccuguccaucaucuucaucaagggcaccuacgccagcgaggaggucaucugggacgugcucuccgggaucggcgugcgcgccggccgggagcacuucgccuucggggagccccgcgagcugcugaccaaggucugggugcaggagcacuaccucgaguaccgggaggugcccaacagcuccccgccccgcuacgaguuccuguggggcccccgggcccacagcgaggucaucaagcgcaaggugguggaguuccuggcgaugcucaagaacacgguccccaucaccuucccguccagcuacaaggacgcccugaaggacguggaggagcgcgcccaggccaucaucgacaccaccgacgacuccacggccaccgagagcgcguccagcuccgugaugagccccagcuucuccagcgag

SEQ ID NO: 76543 - RNA, 1527 nt, Artificial Sequence
  P78395 PRAME
auggagcgccggcgccuguggggcagcauccagucccgguacaucagcauguccguguggaccagcccccgccggcucgucgagcuggccgggcagucccugcucaaggacgaggcccuggcgaucgccgcccuggagcuccugccgcgcgagcuguuccccccccucuucauggccgccuucgacggccggcacagccagacccugaaggcgauggugcaggccuggcccuucacgugccugccgcucggggugcugaugaagggccagcaccugcaccucgagaccuucaaggccguccuggacgggcuggacgugcuccuggcccaggaggugcgcccccggcgcuggaagcugcagguccucgaccugcggaagaacucccaccaggacuucuggaccguguggagcggcaaccgcgcgucccuguacagcuuccccgagcccgaggccgcccagccgaugaccaagaagcggaagguggacggccucuccacggaggccgagcagcccuucauccccgucgaggugcugguggaccuguuccucaaggagggggccugcgacgagcuguucagcuaccugaucgagaaggucaagcgcaagaagaacgugcuccggcugugcugcaagaagcugaagaucuucgcgaugcccaugcaggacaucaagaugauccucaagauggugcagcuggacuccaucgaggaccuggaggucaccugcaccuggaagcucccgacccuggccaaguucagccccuaccugggccagaugaucaaccuccgccggcugcugcucucccacauccacgccagcuccuacaucagccccgagaaggaggagcaguacaucgcccaguucacgucccaguuccugagccugcagugccuccaggcccuguacguggacagccuguucuuccuccgcgggcggcuggaccagcugcugcgccacgugaugaacccccucgagacccuguccaucaccaacugccggcugagcgagggcgacgucaugcaccucucccagagcccguccgugagccagcuguccgugcugagccucuccggggucaugcugaccgacgugagccccgagccccugcaggcgcuccuggagcgcgccuccgccacgcugcaggaccucguguucgacgagugcggcaucaccgacgaccagcugcuggcccuccugcccagccugucccacugcagccagcucaccacccuguccuucuacggcaacagcaucuccaucagcgcccugcagucccuccugcagcaccugaucgggcucagcaaccugacgcacguccuguacccggugccccucgagagcuacgaggacauccacggcacccugcaccuggagcgccucgcguaccugcacgcccggcugcgcgagcuccugugcgagcuggggcggcccuccauggucuggcucagcgccaaccccugcccgcacugcggcgaccgcaccuucuacgaccccgagcccauccugugccccugcuucaugccgaac

SEQ ID NO: 76544 - RNA, 426 nt, Artificial Sequence
  O15392 BIRC5
augggcgcccccacccugccgcccgccuggcagcccuuccucaaggaccaccgcaucagcaccuucaagaacuggcccuuccuggaggggugcgcgugcacgccggagcggauggccgaggccggcuucauccacugccccaccgagaacgagcccgaccuggcccagugcuucuucugcuucaaggagcucgaggggugggagcccgacgacgacccgaucgaggagcacaagaagcacuccagcggcugcgccuuccuguccgugaagaagcaguucgaggagcugacccucggggaguuccugaagcuggaccgcgagcgggcgaagaacaagaucgccaaggagaccaacaacaagaagaaggaguucgaggagacggccaagaagguccgccgggccaucgagcagcucgcggccauggac

SEQ ID NO: 76545 - RNA, 945 nt, Artificial Sequence
  P43362 MAGA9
augagccuggagcagcgcuccccccacugcaagccggacgaggaccucgaggcccagggcgaggaccuggggcugaugggcgcccaggagcccaccggggaggaggaggagaccacgagcuccagcgacuccaaggaggaggaggugagcgcggccggcuccagcucccccccccagagcccgcaggggggcgccuccagcuccaucagcgucuacuacacccucuggucccaguucgacgagggcagcuccagccaggaggaggaggagcccuccagcagcguggaccccgcccagcuggaguucauguuccaggaggcccugaagcucaagguggcggagcugguccacuuccugcuccacaaguaccgggugaaggagcccgugaccaaggccgagaugcuggaguccgucaucaagaacuacaagcgcuacuucccggugaucuucgggaaggccagcgaguucaugcaggugaucuucggcaccgacgucaaggagguggaccccgccgggcacuccuacauccuggugacggcgcucggccugagcugcgacuccaugcugggggacggccacagcaugcccaaggccgcccuccugaucaucguccugggcgugauccucaccaaggacaacugcgcccccgaggaggugaucugggaggcccuguccgucauggggguguacgugggcaaggagcacauguucuacggggagccgcggaagcugcucacccaggacuggguccaggagaacuaccuggaguaccgccaggugcccggcagcgaccccgcgcacuacgaguuccuguggggcuccaaggcccacgccgagaccagcuacgagaaggugaucaacuaccucgucaugcugaacgcccgggagcccaucugcuacccgucccuguacgaggaggugcucggggaggagcaggagggcgug

SEQ ID NO: 76546 - RNA, 1119 nt, Artificial Sequence
  Q9UBF1 MAGC2
augcccccggugcccggcguccccuuccgcaacguggacaacgacagccccaccuccguggagcuggaggacugggucgacgcccagcacccgaccgacgaggaggaggaggaggccagcuccgcgagcuccacgcucuaccugguguucagccccuccagcuucuccaccagcuccagccugauccucgggggccccgaggaggaggaggugcccuccggggucaucccgaaccugaccgagagcauccccuccagccccccccagggcccgccccaggggcccucccagagcccccuguccagcugcugcagcuccuucagcugguccagcuucuccgaggagagcuccagccagaagggcgaggacaccggcacgugccaggggcucccggacuccgagagcuccuucaccuacacccuggacgagaagguggccgagcugguggaguuccuccugcugaaguacgaggccgaggagcccgucaccgaggccgagaugcucaugaucgugaucaaguacaaggacuacuuccccgugauccugaagcgggcccgcgaguucauggagcugcucuucggccuggcgcugaucgaggucgggcccgaccacuucugcguguucgccaacacggugggccucaccgacgaggggagcgacgacgagggcaugccggagaacucccugcugaucaucauccucagcgucaucuucaucaagggcaacugcgccuccgaggaggugaucugggaggugcugaacgccgucgggguguacgcgggccgggagcacuucguguacggggagccccgcgagcugcucaccaaggucugggugcagggccacuaccuggaguaccgggaggugccccacagcucccccccguacuacgaguuccuguggggcccccgcgcccacagcgaguccaucaagaagaagguccucgaguuccuggccaagcugaacaacaccgugcccagcagcuuccccuccugguacaaggacgcccucaaggacgucgaggagcgggugcaggccacgaucgacaccgcggacgacgccaccgugauggccagcgagucccugagcgucauguccagcaacguguccuucagcgag

SEQ ID NO: 76547 - RNA, 2463 nt, Artificial Sequence
  P21802 FGFR2
auggugagcuggggccgcuucaucugccuggucguggugaccauggccacccucucccuggcccggcccagcuucucccuggucgaggacacgacccucgagccggaggagccccccaccaaguaccagaucagccagcccgagguguacguggcggccccgggggagucccuggagguccgcugccugcucaaggacgccgccgugaucagcuggaccaaggacggcgugcaccuggggcccaacaaccggacgguccugaucggcgaguaccuccagaucaagggggccaccccccgcgacuccggccuguacgcgugcaccgccagccggaccguggacuccgagacgugguacuucauggugaacgucaccgacgccaucagcuccggcgacgacgaggacgacaccgacggggccgaggacuucgugagcgagaacuccaacaacaagcgcgcgcccuacuggaccaacacggagaagauggagaagcggcugcacgccgugccggccgccaacaccgucaaguuccgcugccccgccggcgggaaccccaugcccaccaugcgguggcucaagaacggcaaggaguucaagcaggagcaccgcaucgggggcuacaaggugcggaaccagcacuggagccugaucauggaguccguggucccgagcgacaagggcaacuacaccugcgugguggagaacgaguacggguccaucaaccacacguaccaccuggacgucguggagcgcagcccccaccggcccauccuccaggcgggccugcccgccaacgccuccaccguggucgggggcgacguggaguucgucugcaagguguacagcgacgcccagccgcacauccaguggaucaagcacguggagaagaacggcagcaaguacgggcccgacggccugcccuaccucaagguccugaaggccgcgggggugaacaccaccgacaaggagaucgaggugcuguacauccgcaacgucacguucgaggacgccggcgaguacaccugccucgccgggaacuccaucggcaucagcuuccacuccgccuggcugaccgugcugcccgccccgggccgggagaaggagaucaccgcgagccccgacuaccucgagaucgccaucuacugcaucgggguguuccugaucgccugcauggucgugacggugauccugugccgcaugaagaacaccaccaagaagcccgacuucuccagccagcccgccguccacaagcucaccaagcggaucccgcugcgccggcaggugacgguguccgccgagagcuccagcuccaugaacagcaacaccccccugguccgcaucaccacccggcucuccagcacggcggacacccccaugcuggccggcguguccgaguacgagcugcccgaggacccgaagugggaguucccccgcgacaagcucacccuggggaagccccugggcgaggggugcuucggccagguggucauggccgaggccgugggcaucgacaaggacaagccgaaggaggcggugaccgucgccgugaagaugcucaaggacgacgccacggagaaggaccugagcgaccugguguccgagauggagaugaugaagaugaucgggaagcacaagaacaucaucaaccuccugggcgccugcacccaggacgggccccuguacgucaucguggaguacgccagcaagggcaaccuccgcgaguaccugcgggcgcgccggccccccgggauggaguacuccuacgacaucaaccgcgugccggaggagcagaugaccuucaaggaccuggucagcugcaccuaccagcucgcccggggcauggaguaccuggccagccagaagugcauccaccgcgaccuggccgcccggaacgugcucgugaccgagaacaacgucaugaagaucgcggacuucggccuggcccgcgacaucaacaacaucgacuacuacaagaagacgaccaacgggcggcugcccgugaaguggauggcccccgaggcccuguucgaccgcguguacacccaccaguccgacgucuggagcuucggcgugcucaugugggagaucuucacccuggggggcucccccuacccgggcauccccguggaggagcuguucaagcuccugaaggaggggcaccggauggacaagcccgccaacugcacgaacgagcuguacaugaugaugcgcgacugcuggcacgcgguccccagccagcggccgaccuucaagcagcucguggaggaccuggaccgcauccugacccucaccacgaacgaggaguaccuggaccugucccagccccucgagcaguacagccccuccuaccccgacacccggagcuccugcagcuccggcgacgacagcguguucuccccggaccccaugcccuacgagcccugccugccgcaguacccccacaucaacgggagcgucaagacc

SEQ ID NO: 76548 - RNA, 783 nt, Artificial Sequence
  P07288 KLK3
augugggugcccgucguguuccugacccucagcgugaccuggaucggcgccgccccgcugauccugucccgcaucgucgggggcugggagugcgagaagcacagccagcccuggcaggugcucguggcgucccgggggcgcgccgucugcggcggggugcuggugcacccccaguggguccugacggccgcccacugcauccggaacaagagcgugauccuccugggccgccacucccuguuccaccccgaggacaccggccagguguuccaggucagccacuccuucccgcacccccucuacgacaugagccugcugaagaaccgguuccuccgccccggggacgacuccagccacgaccugaugcugcuccggcuguccgagcccgccgagcugaccgacgcggugaaggugauggaccucccgacccaggagcccgcccugggcacgaccugcuacgccagcggguggggcuccaucgagcccgaggaguuccugacccccaagaagcuccagugcgucgaccugcacgugaucagcaacgacgugugcgcccagguccacccgcagaaggugaccaaguucaugcugugcgcggggcgcuggacgggcggcaaguccaccugcagcggggacuccggcgggccccucgugugcaacggcguccugcagggcaucaccagcuggggguccgagcccugcgcccugcccgagcggccgagccucuacaccaagguggugcacuaccgcaaguggaucaaggacacgaucgucgccaacccc

SEQ ID NO: 76549 - RNA, 2250 nt, Artificial Sequence
  Q04609 FOLH1
auguggaaccugcuccacgagaccgacagcgccguggccaccgcgcgccggccccgcuggcugugcgccggcgcccugguccucgccgggggcuucuuccugcugggguuccucuucggcugguucaucaaguccagcaacgaggccacgaacaucaccccgaagcacaacaugaaggcguuccuggacgagcugaaggccgagaacaucaagaaguuccucuacaacuucacccagaucccccaccuggccgggaccgagcagaacuuccagcuggccaagcagauccagucccaguggaaggaguucggccucgacagcguggagcuggcgcacuacgacgugcugcucuccuaccccaacaagacgcaccccaacuacaucagcaucaucaacgaggacggcaacgagaucuucaacaccucccuguucgagccgcccccccccggguacgagaacgucagcgacaucgugccgcccuucuccgccuucagcccccagggcaugcccgagggggaccugguguacgucaacuacgcccggaccgaggacuucuucaagcucgagcgcgacaugaagaucaacugcuccggcaagaucgugaucgcccgguacgggaagguguuccgcggcaacaaggucaagaacgcccagcuggcgggcgccaagggggugauccuguacagcgacccggccgacuacuucgcccccggcgugaaguccuaccccgacggguggaaccuccccggcggcgggguccagcggggcaacauccugaaccugaacggggccggcgacccgcucacccccggguaccccgcgaacgaguacgccuaccgccggggcaucgccgaggccgugggccugcccagcaucccggugcaccccaucggguacuacgacgcccagaagcugcucgagaagaugggcggguccgcgccccccgacagcuccuggcgcggcagccugaaggucccguacaacguggggcccggcuucacgggcaacuucuccacccagaaggugaagaugcacauccacagcaccaacgaggucacccggaucuacaacgugaucgggacgcugcgcggcgccguggagcccgaccgguacgucauccucgggggccaccgcgacagcuggguguucgggggcaucgacccccaguccggcgccgccgugguccacgagaucgugcggagcuucgggacccugaagaaggagggcuggcgcccgcggcgcaccauccuguucgccuccugggacgcggaggaguucgggcuccugggcagcaccgagugggccgaggagaacucccggcugcuccaggagcgcggcgucgccuacaucaacgccgacagcuccaucgaggggaacuacacgcugcggguggacugcaccccccugauguacagccucgugcacaaccugaccaaggagcugaagucccccgacgagggcuucgaggggaagagccucuacgaguccuggaccaagaagagcccgucccccgaguucagcggcaugccccgcaucuccaagcuggggagcggcaacgacuucgaggucuucuuccagcgccugggcaucgcguccgggcgggcccgcuacacgaagaacugggagaccaacaaguucagcggcuacccccucuaccacuccguguacgagaccuacgagcugguggagaaguucuacgacccgauguucaaguaccaccugaccgucgcccaggugcgggggggcaugguguucgagcucgccaacagcaucguccugcccuucgacugccgcgacuacgccguggugcugcggaaguacgcggacaagaucuacagcaucuccaugaagcacccccaggagaugaagacguacagcgucuccuucgacagccuguucuccgccgugaagaacuucaccgagaucgccagcaaguucuccgagcgccuccaggacuucgacaagagcaaccccaucgugcugcggaugaugaacgaccagcugauguuccucgagcgcgccuucaucgacccgcuggggcugcccgaccggcccuucuaccgccacgucaucuacgcccccuccagccacaacaaguacgcgggcgaguccuucccgggcaucuacgacgcccucuucgacaucgagagcaagguggaccccuccaaggccuggggggaggugaagcggcagaucuacgucgccgccuucaccgugcaggcggccgccgagacccugagcgagguggcc

SEQ ID NO: 76550 - RNA, 27 nt, Artificial Sequence
  Linker 1
agcggcggguccggagguucuggcggg

SEQ ID NO: 76551 - RNA, 6 nt, Artificial Sequence
  Linker 2
agaagg

SEQ ID NO: 76552 - RNA, 6 nt, Artificial Sequence
  Linker 3
cugcuc

SEQ ID NO: 76553 - RNA, 30 nt, Artificial Sequence
  Linker 4
ggcgggggagguagcggcgggggaggcacc

SEQ ID NO: 76554 - RNA, 27 nt, Artificial Sequence
  Linker 5
ggcgggggagguagcggcgggggaggc

SEQ ID NO: 76555 - RNA, 12 nt, Artificial Sequence
  Linker 6
ggccccagccug

SEQ ID NO: 76556 - RNA, 24 nt, Artificial Sequence
  Linker 7
ggcagcaccguggccgcucccucc

SEQ ID NO: 76557 - RNA, 24 nt, Artificial Sequence
  Linker 8
accguggccgcucccagcggcucc

SEQ ID NO: 76558 - RNA, 30 nt, Artificial Sequence
  Linker 9
ggcagcaccguggccgcucccuccgggucu

SEQ ID NO: 76559 - RNA, 15 nt, Artificial Sequence
  Linker 10
ggcgggggagguagc

SEQ ID NO: 76560 - RNA, 18 nt, Artificial Sequence
  Linker 11
accguggccgcucccagc

SEQ ID NO: 76561 - RNA, 6 nt, Artificial Sequence
  Linker 12
ggcagc

SEQ ID NO: 76562 - RNA, 9 nt, Artificial Sequence
  Linker 13
cccgccagc

SEQ ID NO: 76563 - RNA, 18 nt, Artificial Sequence
  Linker 14
cccgccgugccuccaccg

SEQ ID NO: 76564 - RNA, 18 nt, Artificial Sequence
  Linker 15
accgugagcgacgucccc

SEQ ID NO: 76565 - RNA, 18 nt, Artificial Sequence
  Linker 16
accggccuggacagcccc

SEQ ID NO: 76566 - RNA, 33 nt, Artificial Sequence
  Linker 17
cacuacggcgccgaggcucuggaaagagcaggg

SEQ ID NO: 76567 - RNA, 9 nt, Artificial Sequence
  Linker 18
gccgcuuac

SEQ ID NO: 76568 - RNA, 12 nt, Artificial Sequence
  Linker 19
gccgcugcagcc

SEQ ID NO: 76569 - RNA, 45 nt, Artificial Sequence
  CV Linker
ggcgggggagguagcggcgggggaggcuccggugggggaggcucu

SEQ ID NO: 76570 - RNA, 27 nt, Artificial Sequence
  Prostate-specific antigen precursor (17-25)
gccgcuccccugauccucagcagaauu

SEQ ID NO: 76571 - RNA, 27 nt, Artificial Sequence
  Prostate-specific antigen precursor (65-73)
cacugcaucagaaacaagagcgugauu

SEQ ID NO: 76572 - RNA, 30 nt, Artificial Sequence
  Prostate-specific antigen precursor (65-74)
cacugcaucagaaacaagagcgugauucug

SEQ ID NO: 76573 - RNA, 27 nt, Artificial Sequence
  Prostate-specific antigen precursor (82-90)
caccccgaggacaccggccagguguuc

SEQ ID NO: 76574 - RNA, 27 nt, Artificial Sequence
  Prostate-specific antigen precursor (188-196)
cacccccagaaggugaccaaauucaug

SEQ ID NO: 76575 - RNA, 27 nt, Artificial Sequence
  Prostate-specific antigen precursor (243-251)
uacaccaaggugguccacuauagaaaa

SEQ ID NO: 76576 - RNA, 30 nt, Artificial Sequence
  Prostate-specific antigen precursor (178-187)
gugaucagcaacgacgucugcgcccagguu

SEQ ID NO: 76577 - RNA, 45 nt, Artificial Sequence
  Prostate-specific antigen precursor (88-102)
cagguguuccaagucagccacuccuuuccccauccucuguacgac

SEQ ID NO: 76578 - RNA, 27 nt, Artificial Sequence
  Kita-kyushu lung cancer antigen 1 (40-48)
cuggugagacccagcuccucuggccuc

SEQ ID NO: 76579 - RNA, 33 nt, Artificial Sequence
  Trophoblast glycoprotein (104-114)
gccgugcugcccgcuggcgcauucgccagaagg

SEQ ID NO: 76580 - RNA, 27 nt, Artificial Sequence
  Trophoblast glycoprotein (33-41)
agccccaccuccucugccucaaguuuc

SEQ ID NO: 76581 - RNA, 27 nt, Artificial Sequence
  Cyclin-dependent kinase inhibitor 2A (68-76)
gccgaggaacugggccacagagacgug

SEQ ID NO: 76582 - RNA, 30 nt, Artificial Sequence
  Cyclin-dependent kinase inhibitor 2A, isoforms 1/2/3 (87-96)
agagagggcuuccuggacacccucgugguc

SEQ ID NO: 76583 - RNA, 33 nt, Artificial Sequence
  Cyclin-dependent kinase inhibitor 2A, isoforms 1/2/3 (87-97)
agagagggcuuccuggacacccucgugguccuu

SEQ ID NO: 76584 - RNA, 27 nt, Artificial Sequence
  multiple tumor suppressor 1/cyclin-dependent kinase 4 inhibitor p16, partial (7-15)
gccagaguggcugagcugcuccuucug

SEQ ID NO: 76585 - RNA, 27 nt, Artificial Sequence
  multiple tumor suppressor 1/cyclin-dependent kinase 4 inhibitor p16, partial (52-60)
gccagacuggacgugagggaugcuugg

SEQ ID NO: 76586 - RNA, 27 nt, Artificial Sequence
  multiple tumor suppressor 1/cyclin-dependent kinase 4 inhibitor p16, partial (63-71)
cugcccguggaccucgccgaggaacuu

SEQ ID NO: 76587 - RNA, 39 nt, Artificial Sequence
  Cyclin-dependent kinase inhibitor 2A, isoforms 1/2/3 (111-123)
ggcagacugcccguggaccucgccgaggaacuugggcac

SEQ ID NO: 76588 - RNA, 27 nt, Artificial Sequence
  Cyclin-dependent kinase inhibitor 2A (58-66)
agaguggccgagcugcuccuucugcac

SEQ ID NO: 76589 - RNA, 30 nt, Artificial Sequence
  GTPase NRas (55-64)
auccuggacaccgccggccaggaggaauac

SEQ ID NO: 76590 - RNA, 2298 nt, Artificial Sequence
  P15056 BRAF
auggccgcucugagcggcgggggagguggcggggcagagcccggacaggcccucuucaacggcgacauggaaccugaggcgggugcuggggccggagcagccgcuuccucugcagccgauccagcuaucccggaagagguguggaauauuaagcaaaugauaaaacuuacccaggaacacaucgaggcccuguuggacaaguuuggcggcgagcauaaccccccuucaauuuacuuagaagcguaugaggaauacacaaguaaacuggaugcacuacagcagagagagcaacagcuccuggagagccuugggaauggaacugacuucuccgucucuucgucagccagcauggauacgguuaccaguuccucuagcuccucacugaguguguugccaagcucucucuccguauuucagaaccccacagacguggcuaggucaaauccuaagagcccacagaaacccaucguccggguguuccugccuaacaagcaacgcacuguugugccagcccgaugcggugucaccgugcgugauagucugaagaaagcacucaugaugagaggcuuaauuccggaauguugcgcuguauauaggauccaggacggggagaagaaacccauaggaugggauacagacaucucuuggcugaccggcgaagagcuucacguugaaguguuggagaaugucccucugacuacacauaacuuugugcggaagaccuucuuuacgcuagccuucugugauuuuugccgcaaacuccuguuccaggguuuuagaugucagacuugcggguacaaguuccaccaaagguguuccaccgaggugccacuuaugugcgucaauuaugaccagcuggauuugcucuuuguuagcaaguucuucgaacaucaccccauuccucaggaggaagcgucgcuggccgagacagcauuaacuucuggauccucaccaagugcucccgccagcgacuccaucggcccgcaaauucugaccucuccuagccccucaaaaaguaucccaauaccucagcccuuucggccagcugacgaagaucaccgcaaccaguucggccagcgagacagauccagcucugcccccaaugugcauauuaacacaaucgagccuguaaauauugaugaccucaucagggaucaaggguuucggggagacgguggcucaaccacggggcuuagugcaacuccaccggccagccugcccggauccuugacaaacgugaaggcucuacagaaaucuccuggcccacagcgugagcgcaagucgagcuccucaagugaagauagaaauaggaugaaaacccugggucggcgagacucuagcgaugacugggagauccccgaugggcagauuacugucggccaacgcauaggauccggcucauucgggacaguguacaagggaaaauggcacggugacguugcggugaagaugcucaacgucaccgcaccuacgccacagcagcugcaggccuuuaagaacgaagugggcguacuuagaaaaaccaggcauguuaauauccuguuguucaugggguauagcacaaagccccaacucgcuauugugacucaguggugugagggaucuucccuguaccaccacuuacauaucauagaaaccaaauuugagaugauuaagcugaucgacaucgcccggcagacagcacagggcauggauuaccuacacgccaaaaguauuauccaucgcgaccucaagagcaacaauauuuuccugcacgaggaucuuacugucaagauaggugacuuuggguuggcuaccgugaaaucuagaugguccggcucacaucaauucgaacagcugaguggaagcauccucuggauggccccggaggucauuaggaugcaggauaagaacccuuauucguuucaauccgacguguacgcauucggcaucguucuguaugaacuuaugacagggcagcugccauacucuaauaucaacaaucgugaucagauuauauuuauggugggacgggguuauuugagccccgaccucucaaaaguacgaaguaacugcccuaaggcgaugaaaagacugauggcugaguguuuaaagaagaaaagggaugagcgcccccuguucccacagauccuagccuccauugaacuccuggcacggucucuuccuaagauccacagaagcgccuccgagcccucauugaauagggcuggcuuccaaaccgaagacuuuagccuguacgccugcgcaaguccaaaaacuccgauucaggcugggggauauggcgccuucccuguccac

SEQ ID NO: 76591 - RNA, 3204 nt, Artificial Sequence
  P42336 PK3CA
augcccccuagaccaagcuccggcgagcugugggggauccaccucaugccgcccaggauucuuguggaaugccuguugccuaacggaaugauagucaccuuagagugucugcgggaagccacacuaaucacuauuaagcaugagcucuucaaagaagcucgcaaguacccacugcaccagcuucugcaagacgagucuucauauaucuuuguuagugugacgcaggaggcagaacgagaggaauucuuugaugagacccguagauugugcgaccucaggcuguuccagcccuuucugaaaguaauugagccuguggguaaucgggaagagaagauccucaaccgcgaaauaggcuucgccaucgggaugccagucugugaguuugauauggugaaagaccccgaaguucaggauuucagaaggaauauuuuaaacgugugcaaggaggcggucgaccugcgggaucuuaauagcccucauucccgcgcuauguacguguauccaccgaacguagagucuucgcccgaauugccuaagcacaucuacaauaaacuggacaagggacaaauuaucguugugauaugggucauugugucaccaaacaaugauaaacagaaguauacacuaaaaaucaaccaugacugugugcccgagcaggucauugccgaagcaauccgaaagaagacuagaagcaugcuccugaguuccgagcagcuuaaacugugcguuuuggaauaccaaggcaaguauauccucaaagugugugguugcgaugaguacuuucuggagaaguacccuuuaucucaguauaaauacauuaggagcuguauaaugcuggggcggaugccaaaucucaugcuuauggccaaggaaucccuguauucacaguugcccauggacugcuucaccaugccgaguuacagccgucgcaucucuacagcuaccccuuauaugaacggagagacuuccacaaaaucacuauggguaauuaauagcgcacugagaaucaagauacucugugccaccuacgugaacgucaauauuagggauaucgacaagaucuaugugcggacgggcauuuaccacggcggggaaccccugugcgacaacguuaacacucagcgagugccaugcaguaauccucgcuggaacgaguggcuuaauuacgauaucuauauucccgaccugccaagagcugccagguugugucucucuauaugcuccgucaaaggacggaagggugcgaaagaagagcacuguccccuggcauggggcaacaucaauuuauuugauuacaccgacacacuggugagcgggaagauggcccuaaaccucuggccuguaccacauggacuggaggaucuuuugaauccgauuggcguuacugguucgaaccccaauaaagaaaccccuugccuggagcucgaauucgacugguuuucuuccguggucaaguucccagauaugucagugaucgaggagcacgcuaacuggagugucagccgcgaagccggguucuccuauucucaugcaggacugagcaauagacuugcuagggacaacgagcugcgugaaaaugauaaggagcaauugaaagccaucucaacacgggacccccucagugaaauuaccgagcaggagaaggauuuucuguggucccaccgacacuacugugugacgauaccugaaaucuuaccaaaacugcuacucagcguuaaguggaacucuagagacgagguggcgcagauguauugccugguaaaagacuggcccccgauuaagccugaacaagccauggagcuuuuggauuguaauuacccagaccccauggucaggggcuucgcagugcgcugccuggaaaaguaucucacugaugacaaacugucacaguacuuaauccagcugguucaggugcuuaaguacgagcaauauuuggauaaccuccugguccgguuucuacugaaaaaggcucucacaaaccagagaauuggccauuucuuuuucuggcaccugaaaagugagaugcauaauaagaccgugagccagagguuugggcuuuugcuggaauccuacugucgcgccugcggaauguauuuaaagcaccucaaccgacagguagaggcuauggaaaaacugaucaaucuuacugacauacugaagcaagagaaaaaggaugaaacacagaaagugcagaugaaguucuugguugagcagaugcggcguccugacuuuauggaugcccuccaagguuuccugucuccccuaaacccagcacaucagcugggcaaucucagacuggaggaauguaggaucaugucgagcgccaaacgcccucuuugguugaacugggagaaucccgacauuauguccgaacuguuauuucagaacaaugagaucauuuucaagaacggggaugaccuccggcaggauaugcugacccuucaaaucauaagaauuauggagaauaucuggcagaaccagggacuggaccuaaggaugcucccauacggcugccugucaauuggugacugcgucggguugaucgaaguggugcgaaauagucacacgauaaugcaaauccaguguaagggcggacugaaaggcgcuuuacaguuuaacucucacacccuccaucaguggcugaaggauaaaaauaagggggagauuuaugacgcggcaaucgaucuuuucacacgcagcugcgccggauacugugucgcuacuuucauucuggguaucggcgaccggcacaacuccaacauaaugguuaaagaugacgggcaauuguuucauauugauuucggacacuuucucgaccacaagaagaaaaaguucggcuauaaaagagaaagggugccguuugugcugacccaggauuuccuaaucguaaucucaaagggugcccaggagugcacaaaaacucgugaauuugagcgcuuccaggagauguguuacaaggcauaccuggccauucggcaacaugcuaaucuuuuuaucaaccucuucagcaugaugcuggggucuggcaugccugaauugcaguccuuugacgauauugccuauauaagaaagacccuggcauuagacaaaacagagcaggaagcgcucgaguacuucaugaagcagaugaaugaugcucaccauggaggcuggaccacuaaaauggacuggaucuuucacacgauuaagcaacaugcccugaac

SEQ ID NO: 76592 - RNA, 567 nt, Artificial Sequence
  P01116 RASK
augaccgaguacaagcugguggucguuggcgccgggggaguggguaaaagcgcucucacaauccagcuuauucaaaaccacuucguagacgaauaugaucccacuauagaggacuccuacagaaagcagguggucaucgauggcgaaacgugccuguuggacauuuuagauaccgcagggcaggaggaauauucugccaugagggaccaguacaugcggacaggagagggcuuucuguguguguucgcgaucaauaacacuaaaucauuugaggauauucaucacuaucgcgaacaaaucaagcgaguuaaagacagugaggaugugccuaugguccuaguggguaauaagugcgaccucccaagccguaccguagauacaaagcaggcucaggaccuggccagauccuacgggauaccguucaucgaaaccucugcaaaaacuaggcagcggguugaggaugccuuuuauacacuugugcgcgagauuagacaauacaggcugaagaaaaucucgaaggaagagaaaacccccggaugugucaagauuaagaaaugcaucauaaug

SEQ ID NO: 76593 - RNA, 1242 nt, Artificial Sequence
  O75874 IDHC
augagcaagaaaaucuccggcgggucuguggucgagaugcagggagacgaaaugaccagaauuauaugggagcugaucaaggaaaaacucauuuuccccuacguugagcuugaucugcacucauaugacuuggguaucgaaaacagggaugccacaaaugaccaagugacuaaggaugcugcagaggccauuaaaaagcauaacguaggcgugaagugcgcgacgaucaccccugacgagaaacgggucgaagaguuuaaguuaaaacagauguggaagaguccaaaugggacaauacgcaacauccugggaggcacuguguuccgagaagcuauuaucuguaaaaauauuccgcgucuaguuagcgguugggugaagcccaucauaauugggagacacgccuacggagaucaguauagggcaaccgacuuugucgugccuggcccaggcaagguagagaucacauacacccccuccgaugggacucagaaaguuacauaucucgugcauaacuucgaggaaggagguggcgucgccauggggauguacaaucaagacaagucuauugaggauuuugcucacucgucauuccagauggcacugagcaaaggauggccucuuuaucugaguaccaagaacacgaucuugaaaaaguacgacggccgguuuaaagauaucuuccaggaaauuuacgacaagcaguauaagucccaauuugaggcccagaaaauaugguacgaacaucgccucaucgacgauaugguggcucaggccaugaagucugaggguggguucauuugggcgugcaaaaauuaugacggagaugugcagagcgacuccgucgcacaaggcuacggcucacuggggaugaugacuaguguucugguguguccagauggaaagaccguagaggccgaagcugcccacgguacagugacuagacacuauaggauguaccagaaaggccaggagaccagcacaaaccccaucgcaucuauauuugcuuggacccgggggcucgcccaucgcgcgaaguuagacaauaacaaggaacuggccuucuuugcaaaugcucuugaggaagucuccauugagacgaucgaggccggauucaugacuaaagauuuggcugccugcaucaagggccugccuaacgugcaacgaucagacuaucuaaauacauucgaauuuauggauaaacucggugagaaccugaagauuaaacuugcacaggccaagcug

SEQ ID NO: 76594 - RNA, 1179 nt, Artificial Sequence
  P04637 P53
auggaggaaccccagagcgacccuuccguggagccaccgcugucucaagaaaccuucucagaucucuggaagcuucugcccgagaacaaugucuugaguccuuuaccaagccaggccauggacgaucugaugcuaucccccgacgauaucgaacagugguuuacagaggacccuggcccagaugaggcucccagaaugccugaagcagccccaccgguugcgcccgcuccugccgcaccaacucccgccgcuccugcaccagcccccucuuggccgcucucgucaagcgugccuagucagaaaacguaccaaggguccuauggauucaggcuggguuuucuucacucuggcaccgcuaagagcguaacaugcacuuacucccccgcccugaacaaaauguucugucaguuggcgaagaccugcccagugcagcucugggucgacucaacaccucccccagggacccgggugcgcgcaauggccauuuauaaacagagucaacauaugacugagguugugcgacguuguccccaccaugaaagaugcagcgauucugacggacuggcuccuccacagcaccugauaagggucgagggcaaucuccggguggaguacuuagaugaccgcaacacauuuagacauuccguaguugugccguaugaacccccugaggucgguucagauuguaccacgauccacuacaauuauaugugcaacagcaguuguauggggggaaugaauaggcggccaauucugacuaucauuacccuugaagacucuuccggcaacuugcugggccgcaauagcuucgaggugcgagugugcgccugucccgggagagacaggcggacagaagaggagaaccuacguaagaagggagaaccucaccaugagcucccacccgguucgacuaaacgcgcacugccgaauaacaccucuuccucaccucagccaaagaaaaagccccuugauggcgaauacuuuacacugcagaucagagggagggagcgguucgaaauguuucgagaguugaaugaggcucucgaacugaaagacgcccaagcgggaaaggagccuggcgguagucgcgcccacagcucccauuuaaagucuaaaaaggggcagagcaccucaagacacaaaaagcugauguucaaaacggaaggacccgauagugac

SEQ ID NO: 76595 - RNA, 567 nt, Artificial Sequence
  P01111 RASN
augaccgaguacaagcugguggucguuggcgccgggggaguggguaaaagcgcucucacaauccagcuuauucaaaaccacuucguagacgaauaugaucccacuauagaggacuccuacagaaagcagguggucaucgauggcgaaacgugccuguuggacauuuuagauaccgcagggcaggaggaauauucugccaugagggaccaguacaugcggacaggagagggcuuucuguguguguucgcgaucaauaacucaaaaaguuuugcugauauuaaucuauaucgcgagcaaaucaagcgaguuaaagacagcgaugacgugccuaugguccucguggguaacaagugcgaucugccaacucguaccguagacacaaagcaggcccaugaacuugcaaaauccuacgggauaccguucaucgagaccucugccaagacuagacagggaguugaagaugcuuuuuauacacuggugagggagauucggcaguaccgcaugaaaaaguugaauucgucagacgacggcacccaaggcuguauggggcuccccugcgucgugaug

SEQ ID NO: 76596 - RNA, 1440 nt, Artificial Sequence
  P31749 AKT1
augagcgacguggccaucgucaaggagggcuggcugcacaaaagaggggaauacauuaagaccuggaggccccgguauuuccuccuuaaaaacgauggaacauuuauagguuacaaggagcgcccucaggacguugaucaacgagaagcuccacugaauaacuucuccguggcacagugccaguugaugaaaacugagcguccgagacccaauacguuuaucauuagguguuuacaguggaccacaguaaucgaacggacuuuccauguggagaccccugaggaacgcgaggaauggacaaccgccauucaaacugucgcggacggccugaagaagcaggaggaggaagagauggauuuuagaucugggucaccaagugacaacagcggagcugaagagauggaagugucccuagccaaacccaagcacaggguuacaaugaaugaguucgaguaucucaaacugcuuggcaaggguaccuuugggaaagugauccuggucaaggaaaaggcaacgggacgguacuaugccaugaaaauauugaagaaagaggugaucguagcuaaggaugaaguugcacauacucucaccgagaaccgcgugcugcagaauucucgacacccuuuccugacagcccucaaauacucguuucagacucaugacagauuaugcuucgucauggaauaugcuaacggcggcgagcuguuuuuccaccuuucaagggagcggguguuuagcgaagaucgugcccgcuucuacggggcggagauugugagugcauuggacuaccugcacuccgaaaagaaugucguuuauagagaucuaaaacucgagaaccugaugcuugacaaggauggacauaucaagauuaccgacuucggucuguguaaagaaggcaucaaggacggggccacaaugaaaaccuuuugcggaacgccagaguacuuggcucccgaggugcucgaagauaaugacuauggcagggccguagauugguggggucuggggguggucauguacgagaugauguguggacgguuaccuuucuauaaccaagaccacgaaaagcuguuugagcucauacuuauggaggaaauucgauucccacgcacucugggcccggaggcaaaaucuuugcuaagcggccugcucaagaaggaucccaaacagagacuggggggagguuccgaagacgcuaaggagaucaugcagcauagguuuuucgccggcauuguguggcagcacguuuacgaaaaaaagcuuucaccuccauuuaaaccccaagugacaagugagaccgauacucgguauuucgacgaggaauuuacagcgcagaugaucaccaucacgccuccagaucaggacgauagcauggagugcgucgacucugaacgcagaccccacuucccgcaauuuuccuacucagccagcgggaccgca

SEQ ID NO: 76597 - RNA, 3912 nt, Artificial Sequence
  O75533 SF3B1
auggccaagaucgcuaaaacccacgaggacauugaagcacagauaagagagauccaaggcaagaaagccgcgcuggaugaagcucagggggugggacucgacagcacagguuacuaugaucaggagauuuacggcggguccgacucuagguucgccggauaugucacuucaaucgcagccacggaacuugaggaugacgaugacgauuacaguagcuccaccucucuguugggccagaagaaacccgguuaucaugcuccuguugcauuacugaacgacauuccacaaucgacagagcaguacgauccguuugccgaacaccggcccccuaagaucgcugaccgcgaggaugaauauaagaaacaucgacguacuaugauaaucucaccagagagacuagaccccuucgccgacgggggaaagaccccugauccaaaaaugaaugcgaggacauacauggacgugaugcgggagcagcaccucaccaaggaagagcgcgaaauuagacagcaacuggcagagaaagccaaggcuggcgaacuuaagguagugaacggcgccgcagcuagccagcccccuaguaaaaggaagcggcgcugggaucagacugccgaccagacaccaggggcgaccccgaaaaagcuguccucuugggaucaagccgagacgcccggacauacuccuagcuugcgaugggacgagaccccagguagagcaaaaggcuccgaaacacccggggcuacuccuggaucaaagaucugggauccaacccccagucacacaccggccggcgcugccaccccugguaggggggacacgcccggacacgcaacuccaggccauggcggggccacaagcucugcucggaaaaaucguugggaugagaccccuaagacugaacgcgacacacccggacacgguuccggcugggcggagaccccaagaacggauagggggggagacucaauuggcgaaacccccacaccuggugcaagcaagcggaaaagucgaugggacgagacuccagccucucagauggggggcuccaccccgguccucacacccggaaagacuccuaucggcaccccagcuaugaacauggccacacccaccccugggcauauaaugagcaugacuccagagcagcugcaagcauggcgcugggaaagagagauugaugaaaggaaucggccccugucggacgaggaacucgaugccauguuuccggagggauacaaaguguuaccuccacccgcugguuauguuccuauccgcacgcccgccagaaagcugacagcaaccccaacuccucuuggcgggaugaccggauuccacaugcagacagaggacaggaccaugaaaucugugaacgaucagcccuccggcaauuugccauuucugaagccggacgauauucaguacuucgacaagcuacucgucgauguggacgaaucaacucugaguccugaggaacaaaaagagcguaagaucaugaaacuucuguugaagaucaaaaacgguacacccccaaugcggaaggcggcucuccgacagauuacggauaaggccagagaguuuggggcaggcccccuguucaaucagauauuaccucugcucaugagcccaacccuugaagaccaggagaggcaccuguugguaaaaguuaucgaucgcauucuauauaagcuggacgaccucgugcggcccuacguccauaaaauccugguggugauagaaccucuucugauugaugaggacuauuacgccagagucgaaggaagggagaucaucuccaacuuggcuaaggccgcaggccucgcuacuaugauuucuacaaugcgcccggauaucgacaauauggaugaguauguucgaaacaccacagcccgggcguuugccgugguagcuagcgcacuggggauuccaucauuacugcccuuccuaaaagccgugugcaagaguaagaaauccuggcaagcucgucacacuggaauaaagaucguccagcagauugccauccucauggguugugcaauccugccucaucuuagaagcuugguggaaauuauagagcacggccugguugacgaacagcaaaaagugaggaccaucucugcgcucgccauugcugcccuggcagaggcugccacgccauacgggaucgaaucauuugauaguguccuuaagccccuguggaaaggaauucgccagcaucggggcaaggguuuggcagccuuccucaaagcuaucggguaccugauaccuuuaauggacgcggaguaugccaauuacuauaccagagaggugaugcugauccuaauuagggaauuucagagcccggaugaggaaaugaagaagaucguacucaaaguugugaagcagugcuguggcacagacggagucgaggcaaacuacauuaaaacugaaauccugcccccauucuucaagcacuuuuggcaacaccgaauggcucuugaucgccggaauuauagacaguugguggacaccacagucgagcuggccaacaaagugggcgccgcugagauaauuuccaggaucguugaugaccucaaggacgaagcagagcaguaccguaagauggugauggaaacuauugagaaaaucauggggaaccugggagccgcggauauagaccauaaguuagaggaacaacugaucgauggcauucuuuaugcuuuccaggagcagaccacggaagacucuguaauguugaaugguuuugggacagucgugaacgcccucggaaaacgcguuaagccuuaccugccccagaucugcggcaccgugcuauggcggcugaauaacaaaucggcaaaggucagacaacaggccgcugaucucauuagcaggacugcagugguaaugaagacaugucaggaggaaaaacugaugggucaccuuggcgugguuuuguacgaguaucugggggaggaauacccagaggucuuaggauccauccucggcgcccugaaggcgauagugaaugugauugggaugcauaaaaugaccccucccaucaaggaccuucugccacgauugacuccgauccucaaaaaccggcacgaaaagguccaggagaauugcauugaucugguuggacgcaucgcugacagaggcgccgaauaugugucagcaagggaguggaugcggauuuguuucgagcuacuggaacuccugaaggcccacaaaaaggcuauacgaagagccaccgugaacacauuugguuacaucgcaaaagcuauugggccucaugauguacuugccacguugcugaauaacuuaaagguccaagagcgccagaauagggugugcaccacuguugcgaucgccauuguggcagaaacauguagucccuucaccguccucccagcucugaugaacgaguaucgugugcccgaacuuaauguucagaacggagugcugaaaucucuaagcuuucucuucgaguacaucggcgagauggguaaggacuauauauacgccguaacaccucuguuggaagaugcucugauggaccgggacuuaguccacagacagacugcauccgccguggugcaacauaugucacucggcgucuacggguuuggaugcgaggauagccugaaucaccuucugaacuauguuuggccaaacguguucgaaaccucuccccauguaauccaggccgugaugggcgcuuuggaggggcucagggucgcgauuggaccuugucgcaugcugcaguacugccuacaaggccuguuucacccggcacgaaaagugagagacguuuauuggaagaucuacaauuccauuuauaucgguagucaggaugcccuuauagcucacuacccacggauuuauaacgacgauaagaauacguacaucagguacgagcucgacuauauccug

SEQ ID NO: 76598 - RNA, 468 nt, Artificial Sequence
  P42771 CDN2A
auggagcccgccgcuggcagcuccauggaaccuucugcagacuggcuggccaccgcggcugccagagggaggguggaggaaguccgggcacuccuugaggccggagcucugccaaacgcaccgaauucauacggucgccgacccauccagguuaugaugaugggcagugcccguguggcugaauuguuacugcuacacggggccgagccuaacugcgcggauccagcaacacucacuagacccguacaugacgccgcuagggagggauuccuggauacgcuugugguccugcaccgggccggcgcacgcuuggacgugagagaugcuugggguaggcucccuguugaccuggccgaagagcuggggcaucgggauguggcgcgcuaucuccgagccgcagcuggaggcaccagaggcagcaaucacgccaggauugacgcugccgaagggccauccgauauacccgac

SEQ ID NO: 76599 - RNA, 3630 nt, Artificial Sequence
  P00533 EGFR
augagacccagcggcaccgccggggcugcacugcucgcccuucuggcggcuuugugcccugccuccagggcauuagaggaaaagaaagugugucagggaacaucuaacaagcugacucaacuagguacguucgaggaccacuuucucucacugcagcggauguucaauaacugcgaagucguucuuggcaaucuggagaucaccuacgugcagcgcaacuaugauuugaguuuucucaaaacaauucaggaaguagccggguacgugcugauagcucugaauacugucgagcgaaucccacucgagaacuuacaaauuauccguggaaauauguauuacgaaaacagcuaugcacuggccgugcuuuccaauuacgacgcuaacaagaccggcuugaaagagcugccgaugagaaaucuacaggaaauucuccauggugccguuagguucucuaacaaucccgcgcuguguaacguggagucgauccaguggcgggauauagucucaagcgacuuucuuaguaauauguccauggauuuccagaaccaccuggggucuugccaaaagugugacccuagcugcccaaacggauccuguuggggcgcaggcgaggaaaauugccagaaguugacaaaaaucauuugugcccagcagugcucagggcgcuguagaggaaagagucccagcgauugcugccauaaccaaugugcugccgguugcaccggcccuagggagucugacugucucgugugccggaaauuucgcgaugaagcaacuuguaaggacacaugcccaccccugauguuauauaauccuaccacguaccagauggauguaaacccagaggggaaauacuccuucggagcuacuuguguuaagaagugcccgcgaaauuauguggucaccgaccacggcucaugugugagagccugcggugcggauagcuacgaaauggaggaggacggggugaggaaauguaagaaaugcgaaggacccugccggaaggucuguaacggcaucggcauuggggaguuuaaagacagucugucuaucaaugccacaaacauaaagcauuucaaaaauugcacuuccauuagcggagaucuccacauccuuccuguugcauuucguggugacucguucacccacacaccaccccuggauccucaggaauuggacauucuaaagaccgugaaggagaucacgggcuuucugcucauccaagcuuggccagaaaaccgcacugaucugcaugccuucgagaaucuugagauuauaagagggaggacaaaacagcacggacaguucucucuggcuguaguguccuugaacaucaccucacucggccugcggaguuuaaaggaaauuagcgacggugaugucaucauauccgggaauaaaaaccuguguuaugccaauacuauuaacuggaagaaacuauuuggcacaucuggacagaagaccaagaucaucagcaaccgaggcgagaauucaugcaaagcaacggggcaagugugucaugcccucugcagucccgaaggauguugggguccggagccucgcgacugcguuuccuguagaaacgugagcaggggccgggaaugcgucgauaaguguaaucugcuugagggggagccccgcgaauucguggagaacucugaaugcauucagugccacccagaguguuugccucaggcuaugaauaucaccugcacaggaagaggccccgacaacuguauucagugcgcgcacuacauagaugguccacauuguguaaaaacuugccccgcagggguuaugggcgagaauaacacccugguguggaaguaugccgacgcuggacacgucugucaucucugccacccuaauuguacauacggcugcacugggccaggacuggaagguuguccgaccaacggccccaaaaucccuucaauugccacagggauggugggagcacuucuguugcuccuggucguggccuuaggcaucggucuguuuaugaggcgucggcauaucguucgaaagagaacccuaaggcgccuccugcaagagcgggaacuuguggagccauugacucccaguggggaagcuccuaaucaggcccugcucagaauucugaaggagacggaguucaaaaagauaaaaguauuaggcagcggagcauuuggcacagucuauaaggggcuguggaucccagaaggagagaaagugaagauucccguugcgaucaaggaacuuagggaggcuaccuccccgaaagccaacaaggaaauuuuggacgaggcauacgugauggccucugucgauaauccucacgugugccgccuccugggcaucugccuaacuucgaccguacagcugauaacacagcucaugccauucgguugucugcuugacuacgugcgagagcacaaagauaacaucgggagccaauauuugcugaauuggugcguucagauugcuaagggaaugaacuacuuagaagaccggcgucucguccauagagaucuggccgcaaggaacgugcuugugaaaaccccccagcacgucaagaucacugacuuuggccuggcuaaauugcucggugccgaggaaaaggaguaucaugcggaaggcgggaagguuccuauuaaauggauggcccuggaguccauccuacaccgcauauacacacaccagucagauguguggaguuauggagugacgguaugggagcugaugaccuucggcucuaagcccuacgacgggauuccagcuagcgaaaucuccucaauucucgagaaaggagaacggcugccucaacccccaaucuguacuauagaugucuauaugaucauggugaagugcuggaugauugacgcagauagcagaccgaaauuuagggagcuuaucauugaguucucuaagauggcccgagacccucagcgcuacuugguuauccagggcgaugaacggaugcaucugcccuccccaacagacaguaauuuuuacagagcuuuaauggacgaggaagauauggacgauguggucgacgccgaugaguaucucauaccccaacaggguuucuuuagcucuccuuccaccucaaggacaccacugcuuaguagccugucggcaacuuccaacaauucuaccguggcguguauugaccguaacgggcuacagagcugccccaucaaggaagauucauuccuccagcgcuacaguuccgacccuacgggagcccugaccgaggauucuaucgacgauacauucuugccgguuccagaguauauuaaucaaagcgugcccaaacggccugcuggcuccguacagaacccagucuaccacaaucagccccugaacccugccccgucaagagacccccauuaucaggauccacacagcacugcaguggguaauccugaauacuuaaacaccgugcaacccacaugugucaauaguacuuuugacucuccagcucauugggcccagaagggcucccaccagaucagccucgacaacccugauuaucagcaagacuucuuucccaaagaggcaaagccaaaugggauuuucaaaggaucgaccgccgaaaacgcugaguaccugaggguugcgccgcagucaucugaauuuauaggcgcc

SEQ ID NO: 76600 - RNA, 540 nt, Artificial Sequence
  P78358 CTG1B
augcaggccgagggcagagggaccggagguagcacaggcgacgcugaugggcccggaggcccugguaucccagacgggccgggaggcaacgcaggcgggcccggagaagccggugcgacuggcgggaggggaccucggggcgcuggugccgcacgcgccuccgggccaggaggcggcgcuccccgagggccucacggaggugcagccucuggccugaaugggugcugucguugcggagcuagaggcccagagucaaggcuccuugaauucuaccuggccaugcccuuugcgacgccuauggaggcagaauuggcccggcgcaguuuagcucaagaugccccaccgcugcccgugccugguguccuacucaaggaguucaccguuagcgggaacauucugacaauaagacuuacugcagcugaccauaggcagcugcaguuguccaucucuucgugucuccagcaacugucacugcucauguggauuacccagugcuuuuuaccaguguuccuggcccagcccccuagcggccagcggcgc

SEQ ID NO: 76601 - RNA, 3765 nt, Artificial Sequence
  P15941 MUC1
augacccccggcacacagagcccuuucuuucugcuccuucuguugacuguguuaacggucguuaccggguccggacacgccucuucaacaccagguggcgagaaggaaacuagugcuacccaaagaagcuccgugccgucuucgacagagaaaaacgcaguaucaaugaccagcagugugcuguccucucauagccccggguccggaucaaguacuacacagggccaggacgucacccuagccccugcgacggaaccagcuagcgguucugccgcaacuugggggcaggaugugaccuccguucccgugacaaggccugcccucggaucaacuaccccacccgcucacgacgucacaagcgcaccugauaauaagccagccccgggcaguaccgcucccccugcccauggcgugacgucugcgccagacacucggcccgcaccuggguccacagccccacccgcucacggaguaaccagcgccccggauacucgcccugcacccgguucgacagcuccaccugcccauggcguuaccucugcgcccgacacgcgaccagcccccggguccaccgcaccuccagcucacggagugacaucagccccggauacucgucccgcuccuggcaguaccgccccacccgcacacggugucacaagcgccccugacacuagaccagcucccggguccaccgcgccgccugcacauggagugacaucugccccagauaccaggcccgcuccuggcagcacugcccccccagcacacggcgugacgucagccccugacacacggcccgcuccagggaguaccgccccgccugcacauggagucacuuccgcgcccgauacccgcccagcucccgguagcacagccccuccagcacacggcguuaccucugcccccgacacuagaccugcuccggggucaacagccccacccgcacacggagugacgagugcuccugauaccaggccagcccccggcagcacugcgccuccggcccaugguguaacauccgcucccgacacccggccagcaccugggucuacagcccccccagcucacggcgugacuucggccccugacacccgccccgcaccaggaagcacggcgccgccugcccauggcgucaccuccgcucccgauacacgaccagcccccgggucaacugcaccuccagcucacggagugaccagugcccccgacacaagaccugcaccggguucuacugccccacccgcucauggcguuaccagcgcgccugauacgaggcccgccccaggguccacagcaccucccgcucacggagugaccucagccccagacacucggccugccccgggcagcacagcucccccagcacacggugucaccucugccccugauacucgucccgcgccaggguccaccgcuccucccgcccauggcgugacaagugcaccggacacgcgcccagccccuggaagcaccgcucccccagcacacggcguaacuucugcccccgauacaagaccugcgccgggguccaccgcucccccagcccauggaguuacaucagcaccugacacuaggcccgccccugguaguaccgcuccacccgcccacggcgugacgagcgcaccugauacacggccagcucccgggucgaccgccccgccugcgcacggagucacuuccgccccagacacccgacccgcaccuggcucuacagcuccacccgcccauggugugacuagcgcuccggauacccgcccugcacccgggucaacagccccaccugcccacggcgucacgagugcucccgacaccagaccagcgcccggauccacugcaccuccagcccauggcgugacaucugcuccggacaccaggcccgccccugggagcacugcaccacccgcccacggaguuacauccgcuccugauacccggccagcgcccggcucaacggccccuccggcacauggugugacuagcgcuccagacacccgccccgccccugggaguacagcacccccagcccacggaguaaccucugcuccugauacuagacccgccccaggcuccacagcgccgccugcacacggugucaccagcgcccccgacacaaggccagcucccggcucgacugccccuccagcucauggggugaccucagcacccgauacgcguccugccccgggaucuacagcuccacccgcccacggcguuaccagugcaccugacacucggccagcgcccggguccaccgccccucccgcucauggagugacaagcgccccagauacucgaccggcaccuggcucuaccgcucccccagcccacggugucacgagcgcaccugacacaagacccgccccaggguccaccgcuccucccgcgcauggagugacuucagccccggauacaaggccagcaccuggcaguaccgcucccccagcccacgguguaacuagcgcccccgacacacgcccugcaccgggcucuaccgcuccacccgcccacggggugacguccgcgccugauacucggcccgcuccaggaucaaccgccccucccgcacauggcguuacaagugccccagacaccagaccugcuccggggagcacagcacccccagcccacggagucacuuccgcgccugauaccaggcccgcuccaggcucuacggccccucccgcacauggugugacaucggccccggacacucgcccagcuccugggagcaccgcccccccagcacacggagugacaucagcucccgacacccgaccugcccccggcuccacugcgccaccugcccacggugucaccagugcaccggauaaccggcccgcucugggcucuacagccccaccuguucauaaugugacgagcgcauccgggucagcuucuggaagcgccaguacucuugugcacaacggcaccuccgcccgugcgacaaccacucccgcuagcaaaucuacaccauucucaaucccuucccaucacagugacacccccacgacucuggcaagccauucgacaaagaccgaugccucuuccacccaccacagcucaguaccgccuuugacuaguucuaaucauuccacaagcccacaacucucaaccggggucaguuuuuucuuucugagcuuccacauuuccaaccugcaguuuaauucuagccucgaggaccccuccacagauuacuaucaggaauuacagagagacauaucagagauguuccugcaaaucuacaaacagggaggcuuucuugguuugucuaacauuaaguucaggccugggagugugguugugcagcugacucuagcuuuucgcgagggaacgaucaauguccaugauguggaaacccaguucaaccaauauaagacagaggccgcaucgcgguacaaucucacuauuagcgacguuuccgugucugauguaccauuucccuucucagcccagagcggcgcuggcgucccuggguggggaaucgcgcugcuugugcuggugugcgucuugguugcccucgcaauaguguaucugaucgcuuuagccguaugucagugcagaaggaaaaacuacggucaacuggacauuuucccagcacgagauaccuaucaccccauguccgaauacccgacauaccacacccauggccgcuaugugccucccaguucuacugaccggagcccauacgagaaggucucagccgggaauggaggcuccagucucagcuauacgaaccccgcuguggccgcgaccucugcaaaucuu

SEQ ID NO: 76602 - RNA, 1260 nt, Artificial Sequence
  Q13641 TPBG
augcccggcgggugcagcagaggaccugccgcuggugacggcaggcugcggcucgcacgccuugcccugguguuguuagggugggucuccucuucaaguccaaccagcuccgcgucuucguucucaagcagugcuccguuucuggccuccgcaguuucugcccagcccccucuaccagaucaaugucccgcucucugcgaguguagcgaagcagcccgaacagugaagugcguaaaccguaaucugacugaggugccuacggaccuuccagcuuacgucagaaaccuguucuugaccggaaaucagcucgccgugcugcccgcgggcgcauuugccaggcggccuccacuggcugaacucgccgcauuaaaccuguccgguucacgccuugaugagguuagagcuggggccuucgaacacuugccgagucugaggcagcuagaccucagccauaauccccuggcggaucuuucuccuuuugccuucuccggaucaaacgcaagcgugagugcuccaucuccccuggucgaguugauccucaaucacauugugccuccagaggacgaacggcagaaccgcuccuuugagggcaugguaguugccgcucuguuagccggccgagcacugcaagggcucagaaggcuugaacuggccagcaaucauuucuuguaucuaccccgggaugugcuggcucagcucccgucgcugcgucaccuugaccugucuaacaauuccuuggucucacucacauacgugaguuuucgcaaccugacucauuuagagagccugcaccuagaggauaaugcgcucaaagugcugcacaacggaacccuugcagaauugcagggucugccucauauaagagucuuccucgacaauaaccccuggguuugugauugccacauggccgacauggugacauggcugaaggagaccgaaguagugcagggcaaagauaggcuuacuugugcuuauccagagaagaugcggaaccgaguccuguuggaacucaauuccgccgaccuggacugcgauccuaucuuacccccaucucugcaaacaagcuacguguuucuagggauuguucucgcacugaucggagccauuuuccuuuuggugcuguaucucaaccgcaaaggcaucaagaaguggaugcauaauauaagagacgcuuguagggaucacauggaggguuaccacuaucgguacgagaucaacgccgacccccgccugaccaauuuaucaaguaacuccgauguc

SEQ ID NO: 76603 - RNA, 3765 nt, Artificial Sequence
  P04626 ERBB2
auggagcuggccgcucucugcagauggggccuucuguuggcauuacugcccccuggggccgcgagcacccagguguguacaggaacugacaugaagcuaaggcucccagcuuccccggaaacgcaccuggauaugcuucggcaucuguaccaagguugccaggucguucagggcaacuuggagcucaccuaucugcccacaaaugccucucugucauuccuccaggacauccaagaagugcagggguacguauuaauugcacacaaccaggugcgccaggucccucugcaacgacuucguauagugagaggaacucaguuguuugaggauaauuaugcccuggcuguucuagacaacggcgauccacucaauaacaccacacccgugaccggugcaaguccugggggacugagggaacuucagcugcggagcuugacugagauccucaaaggcggcguccugauucagcgcaauccacaauuauguuaccaggacacaauccuguggaaggauauuuuccauaaaaacaaucagcucgcccuuacccugaucgacacgaacagauccagggcuugccaccccuguucuccuaugugcaaggggucgcgguguuggggagagucaagcgaagauugccaaaguuugacucgcaccgugugugccgguggcugcgcgcgauguaaagggccacuaccgacagacugcugccaugagcagugugcagccggaugcacuggccccaagcacuccgauugucuggcuugccuccacuuuaaucauucugguauaugugaacugcacugcccugcccuuguaaccuauaacacagacaccuucgagagcaugccaaaucccgaggggagauacacguuuggagcauccuguguuacugcuugcccuuauaacuaccugucaacagaugugggcaguuguaccuuggucugcccacuccauaaucaggaagugacugccgaggacggcacacagaggugugaaaagugcagcaaacccugcgcgcggguguguuacgggcugggaauggagcacuuacgugaaguccgcgccguuaccucugcaaacauccaagaguucgcugguugcaagaaaauuuuuggcucccuggccuuccuaccggagucauuugacggggauccugcuagcaacacggccccccuccagccagaacagcugcagguguucgagacccuugaagagaucacaggauauuuguacauuagugcauggccugacucucugcccgaucucuccguauuucaaaaucugcaggugaucagaggcaggauacuucacaacggugccuauagccugacuuugcaggggcucggcauuucguggcugggauuacggucucugcgagaacuaggcuccgggcucgcucugauccaucacaauacccaucuuuguuucguccacacagugccaugggaccaguuguuucgcaacccccaucaagcgcugcuccacacugcaaauagaccugaggaugagugcguuggagaaggucuggccugucaccaguuaugcgcuaggggccauuguugggggccaggaccgacccagugcgugaacuguucacaguuccugcggggccaagagugcgucgaagagugucgcgugcuucaggguuugcccagagaauacguaaaugccaggcacugccucccuugccauccagagugucagccccaaaacgggaguguuacaugcuucggcccugaggcagaccaguguguggccugcgcucacuauaaggauccacccuuuugugucgcccguugcccgagcggagugaaaccugaccuguccuacaugccaauuuggaaguuccccgaugaagagggcgcaugucagccuugccccaucaauuguacccacucuugcgucgaccuagaugacaagggguguccagcggaacagcgggcuagcccucugacuucaaucauuagugccgugguuggaauacuccuggugguaguccuuggugugguuuuuggcaucuugauuaaacgaagacaacagaagaucaggaaauauacgaugcgccggcuguuacaggagacagagcucguggaaccccugaccccauccggggcaaugccgaaccaggcccaaaugagaauacuuaaggagacugaacugaggaaagucaagguguugggaagcggcgcuuucgguaccguauacaaagggauuuggaucccugacggcgagaaugugaagauccccguugccauuaagguccuccgcgaaaacacaucuccaaaagcaaauaaggagauccuggaugaggcuuacgugauggccggagugggcucacccuaugucagucgacuacuggggauuugccucaccagcacuguucagcuggugacacagcuuaugccuuacggaugcuugcuggaccaugugcgggaaaaccguggcagauuagguucccaggaucuccugaauugguguaugcaaauagcgaaagggaugucuuaucuugaggacguaaggcugguccaccgcgaucuagccgcucggaacgugcucguuaagucgccaaaccaugugaaaaucacggacuuuggacuggcaagauugcuggauauugacgaaaccgaguaccacgccgauggcgguaagguccccaucaaguggauggcuuuagaaagcauccucaggcgacgcuucacucaucaguccgacguguggucauauggcguuacagugugggagcugaugaccuuuggggccaaaccuuacgauggaauuccggcacgggagauaccagaccuucuggaaaagggcgagagauugccccagccuccaaucugcacaauugauguauauaugaucauggucaaauguuggaugauugacagugaaugcaggccccguuuccgcgagcucgugucugaauuuagccggauggcgagagacccucaaagguucguggucauccagaaugaggaucuggggccggccuccccccuagacucaacuuuuuaccgaagccugcuugaggaugacgauaugggagaccucguugaugcugaagaguaccuggugccacagcagggcuucuuuuguccugaccccgccccaggugcagggggaaugguacaccaccggcaucgcucuuccaguaccagaagcggcgguggcgauuugacgcugggguuagaaccuucugaggaggaagcucccagguccccacucgccccgucagagggagcaggcagugacguguucgauggggaccugggaaugggcgccgcuaagggucuucaaagccugccuacccacgaucccucgccauugcagcgguauuccgaagaccccacagucccucucccaucugagacugacggguacguggcgccccugaccugcagcccucagccggaauauguuaaccagccagaugugcgaccccaaccucccucaccaagagagggaccucuacccgccgcacgcccagcuggcgccacacuggagaggccuaaaacucuuaguccggguaagaauggcgucgugaaggacguuuucgccuuugggggagcuguggaaaaccccgaguaccucaccccacagggcggggcagccccucagccccauccaccucccgcguucuccccggcuuuugauaaucuguauuacugggaccaggauccaccugaacguggagcccccccaucuacguucaaaggcacacccaccgcagagaacccugaauauuuggguuuagacgucccggua

SEQ ID NO: 76604 - RNA, 942 nt, Artificial Sequence
  P43357 MAGA3
augccccuggagcagagaagccaacacugcaagccugaagagggccucgaagccaggggggaggcucuuggacuggugggugcacaggccccagcgaccgaagagcaggaggcugccuccucuucaaguacauuggucgaaguuacuuuaggcgaggugccggcagccgaaagccccgacccuccacaguccccccaaggggcuucuucgcugccuacgaccaugaacuacccacuauggucacagagcuaugaggauaguuccaaucaggaggaagagggacccucuacauucccugaccucgaaagcgaguuucaggcagcccugucccggaaaguagcugaacuugugcauuuccuguugcucaaguaccgcgcccgagagccagucacuaaagcggagaugcugggcucagugguugguaacuggcaauauuuuuucccggugaucuuuaguaaggcaagcucuucccugcagcucgucuucgggauugaauuaauggagguggaucccauaggacaccuguacaucuuugccaccugucuuggcuugucauaugacggccugcuaggggauaaucagauuaugccuaaagcuggacuccugaucauuguacuugccaucauagcacgugaaggugacugcgcuccagaggaaaagaucugggaggagcugagcguuuuggaaguguucgagggcagagaagauaguauucucggggaccccaagaaacuguuaacacagcauuuuguccaagagaacuaccuggaauauaggcaggugccuggaucugauccagccuguuacgaguuccucuggggcccccgggcgcuuguggagaccuccuacgucaagguucugcaccauauggugaaaaucagcggugggccgcacauuucguauccucccuugcacgaauggguacuacgcgagggagaagag

SEQ ID NO: 76605 - RNA, 495 nt, Artificial Sequence
  Q17RY6 LY6K
auggcccugcucgcucuucuguugguggucgcauuacccagaguuuggaccgacgccaaccugacagcgaggcagcgggauccugaggacagccaacgcacugaugaaggcgacaaucgaguguggugccacguaugugagcgugaaaacacguucgagugccagaauccaagaagguguaaguggaccgaaccguacugcgugaucgcugccgucaaaauuuuuccccgguucuuuaugguggcaaagcaguguuccgccgggugcgcugcaauggagcgcccuaaaccagaggaaaagagauuccuacucgaggaacccaugccuuuuuucuaucugaaauguugcaagauaagguacuguaaccuugagggaccacccaucaauucuucaguuuuuaaggaguaugccgguaguaugggcgaaagcugcgggggacugugguuggcuauucuccugcugcucgccuccaucgcggcaggcuuaucucugucg

SEQ ID NO: 76606 - RNA, 1032 nt, Artificial Sequence
  P40199 CEAM6
augggccccccuagcgccccaccgugcagacugcacgugcccuggaaggagguccuccuuaccgcuucccuguugacauucuggaacccuccaacuacggcaaaauuaaccaucgaaucuacacccuuuaauguugccgaggggaaggaagugcugcuacucgcgcauaaccugccucagaauaggauuggauacucaugguauaaaggugagcggguagacggcaacagucuuauagugggguacgucaucggaacucaacaggcuaccccaggccccgccuauagcggucgcgaaacaauuuacccuaaugcaucccuguugauccagaacgugacccagaaugauacuggguucuauacacuccaaguuauuaagucugaccuggugaacgaggaggccaccggacaguuucacgucuacccagaacugccgaaacccucgaucucaagcaauaacaguaauccuguggaggauaaggacgcuguagcauucacgugugaaccagagguucagaacacuaccuaucucuggugggugaauggccaguccuuacccgucucuccucgacugcaacuuagcaacggcaauaugacauugacucugcuauccgugaagcguaacgaugccgggucauacgagugcgaaauacagaacccagcuagugccaauagaagcgaccccgugacccucaacguccuguacggaccggaugguccuacaaucucucccuccaaagcgaauuauaggccaggcgagaaccuuaaucugucaugucaugcagccagcaacccucccgcucaguacaguugguuuauuaaugggaccuuccagcaaucuacgcaggaauuguuuaucccaaacauuacuguuaauaacuccggaagcuauaugugccaggcccacaauucggcaacaggccucaaccggaccacugugacaaugaucaccguaucugguuccgcucccgugcugucagccgucgcgacgguggggauaaccauuggaguuuuagcccgcguggcacugauc

SEQ ID NO: 76607 - RNA, 1347 nt, Artificial Sequence
  P19544 WT1
augggcagcgacgugagagaucugaacgcccuccuucccgcugucccuucccuggggggagguggcgggugcgcauugccaguuucuggagccgcgcagugggcuccgguguuagacuucgcccccccuggcgcaucagccuacgguagucuggggggaccagcucccccuccagcacccccuccaccgcccccuccacccccucacagcuuuaucaagcaagagccauccuggggcggcgccgaaccccaugaggaacagugucuaucugcuuucaccguacacuuuucggggcaguucacaggaacugccggugcgugcagguauggcccguuugggccucccccaccuucacaggcaagcaguggacaagcccggauguuccccaaugcuccauaccuccccuccugucuggagucucagccugccauucgcaaccagggcuauagcacggugaccuuugaugguacaccauccuacgggcauacuccgucacaccaugcagcucaguuccccaaucacaguuuuaaacacgaagacccuaugggacaacagggcagccuuggcgagcagcaguauucugucccacccccuguguacgggugccauaccccaacagauuccuguaccggaucacaagcccuguugcuccgaacucccuauagcagugacaaccuguaccagaugacaucucagcuggagugcaugaccuggaaucaaaugaaccucggugcgacguuaaagggcguugccgcaggguccagcucgucugugaaauggacugaaggacaguccaaucacucaaccggcuacgagagugauaaccauacaacuccgauacuguguggugcucaguaucguauccacacccacggggucuucagaggcauucaggacgugaggcggguaccuggaguugccccaacacuugugcgcagcgcuuccgaaaccucugagaagagacccuuuaugugcgccuacccuggcuguaauaaaagguauuucaaguugagccaucugcaaaugcacucacggaagcauacgggggagaaacccuaccagugcgauuuuaaggacugugaacgccgauucaguagauccgaucagcuaaaaaggcaccagcggcgucauacuggagucaagccauuccaaugcaaaacaugccagcgcaaguuuagcagaucugaccaccucaagacccacacuaggacacauaccgguaaaacgucagagaagccuuucaguugucgguggcccagcugccagaaaaaguuugcacgauccgaugaacuggugcgccaccauaacaugcaccagagaaauaugaccaaacuucaacuggccuug

SEQ ID NO: 76608 - RNA, 2106 nt, Artificial Sequence
  P06731 CEAM5
auggagagccccuccgccccuccacacagauggugcaucccguggcagaggcugcuccuuaccgcuucucuguugacauucuggaaccccccuacuacggcaaaguuaaccauugaaucaacaccauuuaauguggccgagggcaaagaaguccugcuacucguucauaaccugccccaacaccuuuucggguacaguugguauaagggagagcggguggacgguaaucgccagauaaucggcuacguaauugggacucagcaggcgaccccuggaccagcuuauagcggccgagaaaucauuuaccccaacgccucccuguugauccaaaauauaauccagaacgauacagguuuuuauacccuccaugugauuaaaucugaccuggucaaugaggaggcaacugggcaguuccguguguacccugaacugccaaagccgucgaucucaagcaacaauaguaaacccguugaggauaaggacgccguggcuuuuacaugugaaccugagacccaggaugcaacguaucucuggugggucaacaaucaauccuuaccagugucucccagacugcagcuuagcaacggaaauaggacuuugacccuguucaacguaacacggaaugacacugccuccuacaagugcgagacccagaacccuguuucagcucgcagaagugauagcgugauucuaaacguccucuacggcccagacgcccccacaaucucuccgcugaauaccuccuauaggucaggcgaaaaccuuaaucugagcugucacgcggcaaguaacccucccgcccaguacucuugguuugugaaugggacguuccaacaguccacucaggaguuguuuauaccaaacauuacagugaauaacagcggaucguauaccugccaagcucauaauucugauacuggucucaaccggacaaccgucacgaccaucacaguuuacgccgaaccucccaaaccauucauuacuuccaauaacucaaaucccguggaggacgaagaugcaguagcucugaccugugagccugagauccagaacacaacuuauuuauggugggugaauaaccagagucugccagucagcccgcgccuccagcuuuccaacgacaaucgaacccugacauugcuaucugugaccagaaacgauguuggccccuacgaaugcgggauccaaaauaagcugagcguggaccacucagacccugucauucucaacgugcuguauggaccagaugaccccacuauaaguccuuccuacacguacuauaggccaggcguaaaucuuagccugucuugucacgccgcgucaaaccccccggcccaguacaguugguugaucgaugguaauauucagcagcauacacaagagcucuuuaucagcaacauaaccgaaaaaaauuccgggcuguauacuugccaggcaaacaauucugcuucgggacacagccggaccacaguuaagaccauuacuguguccgccgaguuaccuaaaccaucaaucaguucuaacaauagcaagcccgucgaagacaaggaugcuguggccuucacaugugagccugaggcacagaacacgaccuaccuguggugggucaauggccagucccuacccgugucaccacgucuccaacugagcaacggcaaccgcacucuuacauuguuuaauguuaccagaaacgacgccagggcuuaugugugcgggauccagaauucuguauccgcgaaccggagugauccugucacacuggacgugcucuacggacccgauacuccaauuaucagcccgccugacucuuccuaucugucaggugcaaaucuuaaccugaguugucauagcgccucgaaucccuccccacaguacucuuggcgaauuaacggcauaccccagcaacacacccagguuuuguucaucgcuaaaauuacgccuaauaacaaugggaccuacgccugcuucgugagcaaccucgcaacaggacgcaauaacucaaucgucaagaguaucacuguguccgccucuggcaccagcccaggucuguccgcuggggccacaguaggcauuaugauaggaguguuaguuggcgucgcacugauc

SEQ ID NO: 76609 - RNA, 2175 nt, Artificial Sequence
  Q99661 KIF2C
auggccauggacagcucccugcaggcuagacucuuccccggccuugcaaucaagauucaaaggucuaacgggcugauacacucagccaaugugcggaccgucaacuuggagaaaaguugcguuagcguggaaugggcggagggaggugcuacaaagggcaaagaaaucgauuuugacgauguagccgcaauuaauccugaguuacugcagcuacucccacugcauccgaaggacaaccuuccccugcaggaaaaugugacuauccagaaacaaaagcgccgauccgucaacucuaagauuccugccccaaaagagucguugcguucaagaagcacgaggaugaguaccguguccgagcuccggaucacagcucaggaaaaugauauggagguugaacugcccgcagccgcuaacucucgcaagcaguucagcgugccuccagcccccacuagaccuuccuguccagcggucgcagagauaccgcugaggauggugucagaggaaauggaggaacagguacacaguauccgggggagcucuuccgccaaucccguuaacucagugcgccgaaaaagcugccucgucaaggagguggaaaaaaugaagaauaagagagaggagaaaaaggcucaaaacagugaaaugaggaugaaacgggcccaggaguacgacucuuccuuuccuaauugggaauucgcacguaugauuaaggaguuucgcgcuaccuuagaaugucauccacugacaaugaccgaucccaucgaggagcacagaauuugcgugugugucaggaaacggccucuuaacaagcaggaauuggccaaaaaggagaucgacguuauaagcauuccaucgaagugccugcuacucgugcaugaacccaaacugaagguagaucuuacuaaauaucuggagaaucaggcguucuguuuugacuucgccuuugaugaaacagcaucuaacgagguggucuaccgauucaccgcucgcccguuggugcaaacgaucuuugagggaggcaaggccacuugcuucgcuuauggucagaccggguccggaaaaacacacacuaugggcggcgaccucucagggaaggcccagaacgcaaguaagggaauuuacgccauggcuagcagagauguuuuucuguuaaaaaaucaaccuuguuauaggaagcugggucucgaaguguacgucaccuucuucgagaucuauaacggcaaacuuuuugaccuguugaauaagaaagcgaagcuacgggugcuggaagacgggaagcagcagguacagguugugggacuccaagagcaccuggucaacuccgcagaugacgugaucaaaaugauugauaugggcucugccugccgcacaagcggucagaccuucgcuaauucaaacaguuccagaagccaugccuguuuucagauaauccuuagggcaaaggggcguaugcacggaaaauucucucuggucgacuuggccggcaaugagcggggcgcugauacgucaagugccgaccgacagacuagaauggaaggggcagagauuaacaagagccuccuggcguuaaaagaaugcaucagggcucugggacaaaauaaggcccauacacccuuucgcgaguccaagcuaacccaggugcuccgggauucuuucauaggugaaaacucgagaacuugcaugauugcaacaaucagcccaggcaucuccucaugugaguacacccugaauacgcuuagguacgccgaccgcguuaaagaguugaguccucacucugggcccagcggagaacagcugauucagauggagaccgaagagauggaagcuugcuccaacggcgcccucaucccagguaaucugucaaaggaggaggaagagcuuagcucucaaauguccaguuuuaacgaagcaaugacacagauucgagagcuggaagagaaagcuauggaggaauugaaggagauaauccagcaggggcccgauuggcucgaacugagcgagaugacugagcaaccugacuaugauuuagaaaccuucgugaauaaagccgagucugcgcuggcccagcaggcuaagcacuuuuccgcacuacgggacguaauuaaagcccuccgucuggcuaugcaacuugaagagcaggccucaagacagaucaguagcaagaagaggccacag

SEQ ID NO: 76610 - RNA, 339 nt, Artificial Sequence
  Q5H943 KKLC1
augaacuucuaccugcuccuugccagcuccauccugugcgcuuugauuguguuuuggaaguauagaagguuccagcggaauaccggcgagaugucuucaaacaguacagcauuagcccugguccgccccagcuccucugggcuaauaaauucgaacacugacaauaaccucgcgguuuacgaucugucacgagacauccuuaauaacuuuccucacagcauugcucgucaaaaaagaauccuggugaauuugaguaugguagaaaacaagcucguggagcuggaacauacgcugcucuccaaaggauucaggggugccucuccacaccggaagagcacc

SEQ ID NO: 76611 - RNA, 303 nt, Artificial Sequence
  P01350 GAST
augcagagacugugcguguacguccucaucuucgcccuugcucuggcagccuuuagcgaggcguccuggaagcccaggucucaacagccugacgcuccauugggcaccggggccaaccgggauuuagaacugccguggcuagagcagcagggacccgcaucacaccaucgccgacaacucgguccucagggcccaccccaccugguugccgacccuaguaaaaagcaggggccauggcuugaagaggaagaggaggcuuauggauggauggauuucggccguagaagcgcagaagacgagaau

SEQ ID NO: 76612 - RNA, 4068 nt, Artificial Sequence
  P35968 VGFR2
augcagagcaaggugcugcucgccgucgcucuuuggcugugcguugagaccagagcagccuccgugggcuugcccucuguaucauuagaccugccuaggcuaaguauccaaaaagauauucucacaauaaaggcgaacacuacgcugcagaucaccugucgggggcagcgcgaccuugauuggcuguggccaaauaaccagagcggauccgaacaacgaguggaggucacagaaugcucugacgguuuguucuguaaaacucucaccauuccgaaggugaucggcaaugauacaggggcuuacaaaugcuuuuaucgugagaccgaccuggccucgguuauuuacguguauguccaggauuacagaucacccuucaucgcaagcgugagugaccagcacggaguaguuuauauaacugaaaacaagaauaagacaguggucaucccuugucugggcuccauuucuaaccucaaugugagcuuaugcgccagguacccagagaaacgguuugugcccgaugguaaccgcaucuccugggacucaaagaaaggguucaccauuccuaguuauaugaucagcuacgcuggaauggucuuuugugaggcaaagauaaaugaugaaucuuaccaguccauuauguauaucguugugguagugggcuacagaauuuaugacgucgugcugucaccaagccauggcaucgagcuuaguguuggggaaaaauuggugcugaacugcacggccaggacugagcuaaaugucggaaucgauuucaacugggaguaccccucuuccaagcaccaacauaagaaacucgugaaucgggaccugaagacccagagcgguucggaaaugaaaaaguuucuuucuacacugacuauugacggcguaacccgcuccgaucagggguuguauacaugugcugccucaaguggacucaugaccaaaaagaacagcacguucguucgagugcacgagaaaccuuuugucgcguucggcuccgguauggaaucucugguggaggcaacugucggggaaagagugaggauaccagccaaguacuuaggauauccgcccccugagaucaagugguacaaaaauggcauuccacuggagagcaaccauacaaucaaggcuggccacguucucaccauaauggaagugucagagcgggacacugggaacuacacaguaauucuuaccaaucccaucaguaaagaaaagcagucccacgucgugagccugguuguguaugucccuccacaaaucggagagaaaucuuugauuucacccguggauaguuaccaguaugguacgacccagacacuaacuugcaccguauacgccaucccgccuccccaucacauucauugguauuggcaacuggaagaggagugugcaaacgaaccaagccaggcuguguccguuacaaauccuuaccccugcgaggaauggcguucugucgaggacuuucagggcgggaacaagauagaagugaauaagaaccaguucgcccucaucgagggaaaaaauaagacugugucgacccuggucauucaagcggccaacguuagcgcacuuuauaaaugcgaggcugugaauaaggugggccgcggugaaagaguaaucuccuuucacgucacaagggggccagagaucacccugcagcccgauaugcagccuacugaacaggagucagugaguuugugguguacggccgaccggucuacauucgagaaccucaccugguacaaacugggcccacaaccguuacccauucacguuggagaacugccuacuccagugugcaagaaucuagauacccucuggaagcugaacgcuacaauguucagcaauuccaccaacgacauacuuaucauggaguugaaaaaugccucacugcaggaucagggcgacuacgucugucucgcacaggaucgaaagacuaaaaagcgccauugcgugguuagacaacugacagugcuugaaaggguagcccccacgauuaccgggaaccuggagaaccagacuacaagcaucggagaaucuauugaggucuccuguaccgcuagugguaauccuccaccccagaucaugugguuuaaagacaacgagacauugguggaagacagcggcauagugcucaaggaugggaaucggaaccugacuauccgcagagucaggaaggaggacgaaggauuauauaccugccaggcguguucuguucugggcugcgcaaaaguggaggccuucuuuauuaucgaaggugcucaagagaagacgaaucuagagauuaucauacucguagggaccgccgugauugcaauguucuuuuggcugcuuuuggucaucauucugcguacagugaaacgggccaacggcggagaacucaagacuggcuaccuguccaucguuauggauccggacgaguuaccucuggaugaacacugugagcgacuuccauaugacgcuucaaaaugggaauuccccagagauagguugaagcucgggaaaccucugggacgcggugccuuuggccaggugauagaggcagacgcguucgggaucgauaagaccgcuacaugccggacugucgccgugaagaugcuaaaagagggagcaacccauagugaacacagagcccugaugagcgagcucaagauucugauccauauuggccaccaccuuaauguugugaacuugcugggugcuuguacgaaacccgggggcccauuaauggucaucguagaauuuugcaaguucggaaaucucucgacauaccugagguccaaacgcaacgaguuugugccuuauaagaccaagggcgcccgauuccggcaggggaaagacuacguuggagcaauacccguggaucuuaagcguagacuggacucuauuacuagcucacaaaguuccgcuucuagcggcuuugucgaggaaaaauccuugucagauguggaggaagaggaagccccagaggaccucuauaaggacuuccugacacuagagcaucugaucugcuacagcuuccagguagcgaaagguauggaauuucucgccaguaggaaguguauccaccgcgaucuggcugcacggaauauucuuuugucugagaagaacguggucaaaaucugcgacuucgggcuggccagagauauuuacaaggacccggauuauguuaggaaaggagacgcucgauuaccucucaaguggauggcccccgaaaccauauuugaucgcguguacacuauccaguccgacguguggagcuucggcguccugcuuugggagauuuuuucgcugggugcaucaccauaucccggcgugaaaaucgaugaagaguucugucggagacuaaaggaggggaccaggaugcgugcgccugacuacacaacgccagaaauguaucagaccaugcucgauugcuggcauggagagcccucucaacgcccuacuuuuagugaacugguugagcacuugggcaaucuguuacaggccaacgcucagcaggacgggaaggauuacauuguacucccgaucuccgaaacacugagcauggaggaggacucuggacuuagccugccaaccucccccgugucauguauggaagaggaagaggucugcgacccuaaauuccacuaugauaauacagccggcauaagucaauacuugcagaacagcaagcggaaaucuagaccaguguccguuaagacuuuugaggacaucccccucgaagagccugaagugaaagucauuccggaugacaaccagaccgauucagguauggugcuggcaagugaggaacuaaagacgcuggaggacaggacaaaacuuagccccuccuucgggggaaugguaccaucuaagucgcgagagagcgucgcuucagaaggcuccaaucagaccagugguuaccaaucuggcuaucauagcgaugacacugauaccacaguguacuccucagaggaagccgagcuccugaaguugaucgaaauugggguucagacuggaucuaccgcacagauccugcaaccugacagcggcacaacguuaaguucccccccagug

SEQ ID NO: 76613 - RNA, 801 nt, Artificial Sequence
  P09237 MMP7
augagacugaccgugcucugcgccgucugucuucugcccggcagcuuggcuuuaccucugccacaggaggcagggggaauguccgaacuacaaugggagcaggcccaggacuaccucaagagguucuaucuguacgauucugaaacaaaaaacgcgaauucacuugaggcuaagcugaaagaaaugcagaaguuuuucgguuugccgaucacuggcaugcucaacagucggguuauugagauaaugcaaaaaccccgcugcggggugccugacguagccgaguauagccuguuuccaaauucccccaaguggacgucuaagguggucaccuaccgaaucgugucguauacacgugaucugccucacauuacuguugacagacucgugucaaaagcauuaaacauguggggaaaggaaaucccacugcauuucaggaaagucguguggggcaccgccgauauuaugaucgguuuugcucggggggcacacggagacagcuaccccuucgauggcccuggcaauacacuugcccaugcuuuugccccagggaccggauuggguggcgacgcgcacuucgaugaggacgaacgcuggacugaugggaguucccugggaauaaacuuucuauaugcagccacacaugagcucggccacucucuggguauggggcacagcuccgacccgaaugcuguaauguaccccaccuacggaaacggcgauccucagaauuucaagcuuucacaggacgacaucaaaggcauucagaagcuguaugggaagagaaguaacagcaggaaaaag

SEQ ID NO: 76614 - RNA, 5460 nt, Artificial Sequence
  Q96Q89 KI20B
auggagagcaacuucaaucaggaaggcgugcccagaccuuccuacgucuuuucugccgacccaaucgcuaggccgucagagauuaacuucgaugggauaaagcuggaccucagucacgaauuuagccuuguugcacccaauaccgaggccaacuccuucgaaucuaaagauuaucugcaagugugcuugcggauccgcccuuuuacacagucggagaaggaguuagaaucagagggauguguacauauucuggacagccagacugugguccuaaaagaaccacagugcauccucggucgacugagugagaaguccucuggccaaauggcgcagaaauucagcuuuuccaagguguucgggcccgcuacgacccagaaggaguuuuuccagggauguauuaugcaaccuguuaaagaucuucugaagggccagucacguuugaucuuuacauacggucucacuaauagugggaaaaccuauacauuccagggaaccgaagagaacauaggcauccugccaagaacucugaaugugcucuuugacagcuuacaggaaaggcuguacacaaagaugaaccuuaaaccccaccggucucgcgaguauuugagacuguccucagaacaagagaaggaggaaauugccagcaagagugcacuacucaggcagaucaaagaggucaccgugcauaaugauucugacgauacgcuguacggcucccuuacuaacagccugaauauuucggaauucgaggaaucuaucaaggacuaugagcaggccaacuugaauauggcuaacuccauaaaauucucaguauggguuaguuuuuucgagauuuacaaugaauacaucuaugaucucuuugugccugucagcuccaaguuccaaaaacggaagaugcugcgcuuaucucaggacgugaaaggguacagcuuuauuaaggaucugcaguggauccaggugucagacaguaaggaggcauaucgacuccuuaaacugggaaucaagcaccaauccgucgccuucaccaaauugaacaacgcuagcucuagaucacauaguauuuuuacaguuaagauacuacagaucgaagacagcgagauguccagggugauucggguaucugaacugucgcucugcgaucuggccgguagcgagcguacuaugaaaacccagaaugagggcgaacgccuuagagagacagggaacaucaauaccucccuguugacgcucggaaaguguauaaacgugcugaagaauucagaaaaaaguaaguuccagcaacacgucccauuuagggagucuaaauuaacucacuacuuccagagcuuuuucaacggcaaggguaaaauuugcaugaucgugaauaucucccaguguuaucuggcguacgacgagacacuaaacguucucaaguuuucagcaauugcccagaaggugugcgucccggauacccugaauagcucucaagaaaaacuuuucgggcccgugaaguccagucaggacguaagcuuggauucuaacuccaauucaaaaauccugaacguuaagcgggcuacuauuaguugggagaauagccucgaagaccugauggaggaugaagaccuuguggaggagcuggaaaacgccgaggaaacacagaaugucgagaccaaauugcucgaugaagaccuggauaagacguuagaggagaacaaggcauucauaucgcaugaagagaaacgaaagcugcuagaccucaucgaagaccugaaaaagaaacuuauuaacgagaagaaagaaaaguugacccuggaguuuaagauccgcgaggaagugacacaggaguucacucaauauugggcucagagagaagccgauuuuaaagagacccuccugcaggagagggaaaucuuagaggaaaaugcggagcggcgccuggccauuuucaaggaccuugucggaaaaugugauacaagagaagaggcagcuaaggacauaugcgccacuaaaguggagaccgaagagacacacaacuacguuggcuuugaagauaucauugacuccuugcaagauaauguggcugacaucaagaagcaggccgagauugcacaucucuacaucgccucucugccugauccacaggaagcuaccgcgugucuagagcugaaauucaaccagauaaaggcagagcucgccaaaacuaagggcgaacugaucaaaacgaaggaggaacuuaagaaaagggagaaugaaagcgacucauugauucaagagcuggagacaaguaacaagaaaaucauuacccagaaucagcguaucaaggaauuaauaaacauuaucgaucagaaagaggacacuauuaaugaauuucaaaaccucaagucccacauggagaauaccuucaagugcaacgauaaagcugacacaucuagccugaucauaaauaacaagcuuaucugcaaugagaccguagaaguccccaaagacuccaagucaaaaauuuguagcgagcggaagcgagugaacgaaaacgagcugcagcaggaugaaccuccagccaaaaaggggaguauccacguuucuuccgcaauuacugaggaccagaagaaaagcgaggaagugagacccaauaucgccgagauagaagauauuagggucuugcaagagaacaaugaaggacuccgcgcuuuucugcuaacaaucgagaacgagcugaagaaugaaaaagaggaaaaggccgagcucaacaaacagaucgugcauuuccagcaagaacugucgcuuucagagaagaagaauuugacgcugucuaaagagguacagcagauucagaguaacuaugacaucgcaauugcggaauuacacgugcaaaaguccaaaaaucaggagcaggaagagaagauaaugaaacucagcaacgagaucgaaaccgcuacucggucuauuacaaauaacguuagccagaucaagcugaugcauaccaagauugaugagcuuagaacacuggacuccgucucacaaaucaguaauauagaucuacucaaccugagggacuugagcaaugguucugaagaggauaaccugccgaacacucaguuagaccuccugggcaaugauuaccuuguguccaaacaggugaaggaauaucgcauccaggagccuaaccgagagaauucauuucacaguagcauugaagccaucugggaggaaugcaaagagauugucaaggcauccucuaaaaagucgcaucaaaucgaagagcuggagcagcagauagaaaaguugcaggccgagguuaaaggguacaaggacgaaaacaaucggcucaaagagaaggaacacaaaaaccaagaugaccugcuaaaggagaaggagacccugauucagcagcuuaaagaagagcuccaagaaaagaaugugacgcuggacgugcagauccagcacguagucgagggaaaacgugcuuugagcgagcugacccagggcgugacauguuauaaggccaaaaucaaggaauuagagacuauucucgaaacccaaaaaguugagugcucacauuccgcaaagcuggaacaggauauacuugagaaggagaguaucauucugaaauuggaaagaaaccucaaggaguuccaggaacaccugcaggacucugugaaaaauacaaaggaucuaaacgucaaagagcugaagcuuaaggaagagaucacucaacucaccaauaaccugcaggacaugaaacauuuguuacagcugaaggaggaagaggaagagacgaauaggcaggaaacagagaaacucaaggaggaacugagcgcuuccucagcccgcacccaaaaccuuaaagcggaucugcagcggaaggaggaagacuacgccgauuugaaggagaaacuaacugacgcuaagaaacagauuaagcaagugcagaaagagguuucugugaugagagaugaagacaagcugcucaggaucaagauaaaugagcuggaaaaaaagaaaaaccaguguagccaggagcuugauaugaagcaacgaacaauccagcaguuaaaagaacagcugaauaaccaaaagguagaggaggcaauucagcaguaugaacgcgccugcaaagaccucaacgucaaggagaagaucauugaagacaugcggaugaccuuggaggaacaggagcaaacucagguggagcaggaucaggugcuggaagcuaaacucgaggaagucgagagacuggccaccgaacuugagaaguggaaagagaaguguaaugaccuggaaacaaaaaacaaucaaaggaguaacaaggagcacgaaaauaacacggauguuuuggguaagcuaaccaaucugcaggacgagcuccaggaguccgaacaaaaauacaacgcagaucguaagaaaugguuagaggaaaagaugaugcugaucacucaggcgaaagaggccgaaaauauacgcaacaaggagaugaagaaauacgcugaggaccgggaaagauuuuucaagcagcagaaugagauggaaauucuuacagcccaacugaccgagaaagauagcgaccuccagaaguggagggaagagcgagaucaguugguggcagcucuggagauccagcucaaagcccugaucucuucaaacguacaaaaggacaaugaaauugagcagcuuaagcggaucauauccgaaacaaguaaaauugagacucagaucauggauauuaagcccaaacgcaucagcucggcagacccagauaagcuacagaccgaaccucugucuacguccuucgagauaagcagaaacaaaauugaggacgggucaguggucuuggacaguugcgaagugucuacagagaaugaucaauccaccagguuucccaagccagaauuagagauccaguucacuccccugcagccuaacaaaauggccguuaagcacccaggcuguaccacaccggugacugucaagauccccaaagcucggaagcgaaaaagcaacgagauggaagaggaccucgugaagugcgaaaauaaaaagaacgcgaccccuagaacaaaucugaaguuuccaauuucagaugaccgcaacaguagcguuaaaaaggagcaaaaaguggccaucaggcccuccucuaagaaaacguauagccuucguucccaggcaucaauuauaggagucaaucuggcuaccaagaagaaagaaggcacucuccagaaguucggggauuuuuugcagcauucuccuaguauccugcaaucgaaagccaagaaaauuaucgagacaaugagcuccucuaagcuaucaaacguagaggccagcaaggaaaaugugucccagccaaaacgggcuaagagaaaacuguacaccagugagaucucuagccccauugacauaucaggacagguuauccucauggaucagaagaugaaagaauccgaccaccaaauuaucaagaggcgccuucgaacuaagacagcaaaa

SEQ ID NO: 76615 - RNA, 951 nt, Artificial Sequence
  P43358 MAGA4
augagcuccgagcagaagucucaacacugcaaacccgaagagggcguggaagcccaggaggaagcucuggggcucgucggagcacaggccccuaccacagaggagcaggaagcggcuguuucaaguagcuccccacuugugccggguacucuggaggaaguacccgccgcagagucugccggcccuccacaaucgccccagggggcuucagcauugccuacgaccaucagcuucacauguuggagacagccaaacgagggaaguuccucucaggaagaggaaggccccagcacuuccccugacgccgagucauuauuuagggaagcucugaguaauaagguggaugagcuagcccauuuccuccugcggaaauaccgcgcgaaggagcuugucaccaaagcagaaaugcuggagcgagugauuaagaacuauaagcguugcuuuccaguuauauucgguaaagccagcgaaucuuugaagaugaucuuugggauugacgugaaagaggucgauccggcuuccaauacauacacccucgugacuugucugggacugucauaugacggccucuuaggcaacaaucaaaucuuccccaagacagggcugcuuauuaucguauugggaaccauagccauggaaggugauagcgcaagugaggaggaaaucugggaggaacugggcguuauggggguguacgacggaagagagcacacggucuauggcgaaccuaggaaacuacucacucaggauugggugcaggagaacuaccuggaguaucggcaggugccagguucuaaucccgcucgcuacgaauuucuuugggggccuagagcccuggcggagaccuccuacgucaagguuuuggaacaugugguaagggugaacgcccggguccgcauugcauauccaagccuccgagaggcugcccuguuagaggaagaggaaggagug

SEQ ID NO: 76616 - RNA, 927 nt, Artificial Sequence
  P43355 MAGA1
augagccuggagcagagaucccuccacugcaagcccgaagaggcccuugaagcucaacaggaggcacugggcuugguguguguccaggccgcgaccucuucaaguagcccuuuaguucuggggacacuagaagaggugccaacugcuggauccacggacccgccccagucuccucaaggugccucggcauucccaaccacaaucaacuuuacuaggcagcggcagcccucagagggcagcaguucccgcgaagaggaagggccuucuaccagcugcauucucgagucccuguuccgagccguaauaacaaaaaagguggcugaucuugucggauuucuguugcucaaauaccgugcaagagagccagugaccaaggccgaaaugcuggagucaguuaucaaaaauuauaagcauuguuuccccgaaauuuuuggcaaggcuagugagagccugcagcucguguucgguaucgacgucaaagaagccgauccuacugggcacucuuacguguuaguaacaugccugggacuuuccuaugacggcuugcugggcgauaaccaaauuaugccaaagaccggguuucuaaucauaguucucgugaugaucgcgauggagggaggucaugcaccggaggaagagauuugggaagagcugucagucauggaaguguacgacggcagggagcacagcgccuauggggagccccggaaacuucugacgcaggauuuggugcaggaaaaguaccucgaguaucgccaggucccugacagugauccagcuagauacgaauuccuguggggacccagggccuuagcagagacuucuuacguuaaagugcuggaauauguaaucaagguguccgcucggguccgcuuuuucuuuccuagccuccgagaggccgcgcuuagagaggaagaggaaggcgug

SEQ ID NO: 76617 - RNA, 3426 nt, Artificial Sequence
  O60732 MAGC1
augggcgacaaggauaugcccaccgccgggaugccuagccugcuccaguccucuucagagaguccacaaagcugcccggaaggagaggacucccagucuccccuucagaucccucagucgucaccagaaagcgaugacacacuguaccccuugcaaaguccucaguccagaucugagggugaagauagcuccgacccauuacagaggcccccugagggcaaagauucacagaguccacugcaaauuccgcagagcucucccgagggggacgauacucaguccccucuacagaacucacaaagcaguccagaaggaaaggacucucucuccccccuggagauaagccagucgccuccagaaggcgaggaugugcagucuccccuucaaaauccggcuuccucauucuuuaguagcgcacuguuguccaucuuccagucuagcccugagucaacgcagagucccuuugaagguuucccacaguccguccuccaaauuccuguuagcgccgcgucuucaaguacccuggugagcaucuuucaguccucucccgagucgacacagagcccauucgaaggguuuccccaguccccucugcaaauuccaguaucacggaguuucucuagcacucucuuauccaucuuucagucaagcccggagcgcacccagucuacauucgaaggauuugcucaguccccccugcaaauaccugugaguccaagcucuuccucaacccuuuugagucuguuccagagcuuuucggagcgaacucaguccacauucgagggcuucgcccagucuagccuacaaauccccgucucaccuaguuuuuccucuacccucgugagccuguuccaguccucaccagaacguacgcagagcacuuuugagggcuucccccaaaguccgcuucagauuccuguuucuuccagcucgucaucuacccuguugagucucuuucaguccagcccagaaagaacacacucuacuuucgagggguuuccccagagccuguuacaaaucccuaugaccuccucauucaguagcacacugcucucuauuuuucaguccucacccgaaagugcacagagcaccuucgagggauuuccacaguccccucuucaaauccccgguucuccaucguucagcucaacgcuguugucccuauuucagaguucuccggagaggacucauagcacauucgaaggcuucccucaguccccccugcagauaccaaugaccucaucuuuuagcaguacucuccuguccauucuucaaagcucucccgagucagcccaguccgcuuucgaaggguuuccucagaguccacugcaaauccccgugagcucgucuuucuccuauacauugcucagccuguuucagucaaguccugagcggacccacucuacguucgaaggauuuccgcaguccccauuacagauucccgucagcucaaguagcuccucuagcacccugcuaucccucuuccaaucaucuccugaguguacacagaguacuuuugagggcuucccacagucgccccugcagaucccucaaagcccgcccgaaggugagaacacccauuccccacuucagaucgugccuucuuugcccgaaugggaggacucacugagcccacacuacuuuccucagucccccccacagggggaggauagucucucuccgcauuauuucccucaaagccccccacagggagaagacucacuguccccccacuacuuuccucagaguccacagggcgaggacagccuuucuccccacuauuucccucaauccccgccacagggcgaagauucaaugagcccccuguacuucccucagucgcccuugcaaggggaggaauuucagucuagucuccaguccccaguaagcauuugcucauccucuacaccuagcagucugccccaguccuucccagagagcucucaaucaccuccggagggacccguucagaguccauuacauuccccucagagccccccagaagguaugcacucucagucgccucugcaaucacccgagagcgcaccggaaggcgaggacucccuaaguccacuccagauaccucagucuccccuggaaggggaggauagccuuuccucauugcauuuuccacagagucccccugagugggaagacucucugagcccgcuccacuucccccaauuuccaccucagggagaggauuuccaguccucacugcaaagccccgugucuaucuguuccaguagcacuucguuaucccugccucagucuuuuccagaaucaccccagagcccuccagagggccccgcccagaguccgcuucaacgcccugucuccucuuucuuuagcuauaccuuggcuucacuccugcaguccagucacgaaagcccacagucucccccugaggguccagcccagucaccccuacaauccccggugagcucuuucccuaguucgacauccagcucacugucucagagcucccccgugaguucauuuccaucuagcaccuccaguagccucuccaaaucuucaccugagagcccccugcagucgccagucauuuccuucaguucuagcacuucacuuucccccuucucugaagagaguagcuccccuguugacgaauacacgucaagcucugauacauugcuggagagugacuccuuaaccgauagcgagucacucaucgaaucugagccacuguuuacuuacacccuugacgaaaagguggaugagcuggcgagauucuugcuccugaaauaucagguaaagcaaccgauaacaaaggcagaaaugcuaaccaaugugauuuccagguacacuggguauuuucccgucaucuuccggaaagcccgcgaguuuaucgagauucuguucggcaucucgcuccgagaaguggacccugacgauagcuacguuuuugugaacacacuggaccuuacgagugagggaugcuugucugaugaacagggcaugucccagaauagacuguuaauucucauacugagcaucauuuucaucaaggggaccuaugcuucagaggaagucaucugggacgugcuuaguggaauugguguaagggccggccgggagcauuuugcauucggggagccacgugaacugcuaacuaaaguuugggugcaggagcacuaccucgaauaucgcgagguccccaacuccagcccuccaagauacgaauuucuguggggacccagggcucauucugaggugauaaagcggaaagucguggaguucuuggccaugcugaagaauacaguuccuaucaccuuuccgucaagcuacaaggaugcguuaaaagacguggaagagcgagcccaagcaauuaucgauacaacugacgauuccaccgcuacggaaucugccaguucgagcguaauguccccaucauucucuagcgag

SEQ ID NO: 76618 - RNA, 1527 nt, Artificial Sequence
  P78395 PRAME
auggagagaaggcggcuguggggcagcauccagucccgcuacauuucuaugucaguguggaccaguccccgacgucucgucgaacuugccgggcaaagccuguugaaggacgaggcuuuagcaauagccgcgcuggaacuacucccuagagagcuguucccaccgcuuuuuauggcugccuucgauggaaggcacucccagacacugaaagcaaugguucaggccuggcccuuuacuugcuugccucucggugugcugaugaagggccagcaucugcaccucgaaacguucaaagcuguauuagacgggcuggaugugcuuuuggcacaagagguccggccacgcagauggaagcugcaggugcuagaccucaggaaaaacucucaucaggauuuuuggaccguuuggucgggaaaucgggccucacuguauagcuuccccgagccugaagcugcccagccaaugacaaagaagcgcaaaguggacggccuuaguacugaggcggaacaacccuuuaucccugucgaggugcugguagauuuguuccucaaggagggugcaugugacgaacuguuuuccuacuuaauugagaaaguuaagcgaaaaaagaacgugcugagacucugcuguaagaaacuuaagaucuucgccaugccaaugcaggauauuaaaaugauccugaagaugguccaguuggacucuauagaagaucuagaggugaccugcacauggaaacugccgacccucgcuaaguuuagccccuaucuggggcagaugaucaaucuuaggcggcuguugcucucccacauucaugccucaaguuacaucagcccugaaaaagaggagcaauauauugcacaguucacuucucaguuucuguccuuacaaugucugcaggcucuauacguggacucacucuucuuccugcguggacgccuugaucaguugcugagacacgucaugaacccacucgaaacacugagcaucaccaauugcaggcuuagugagggcgacguuaugcaccugucucagucccccagcgugucgcaauugucuguacucucccugucaggcgugauguuaacggacgucaguccugaaccacugcaggcccuacucgagcgggcgagcgccacucugcaggaucuuguguuugacgaaugugggauaaccgaugaccaguugcuggcacuccugcccuccuuaucucauugcagccaacugacaacucuuucauucuauggaaacaguauuuccaucagcgcuuugcagucucuccugcagcaccuaauuggucugucaaaucucacccauguucuguacccggugccucuugagaguuacgaggauauccacggcacauugcaccuggaacgauuagccuaucuccaugcucgccugagagagcuucugugugaauuggggaggcccagcauggucuggcucuccgccaacccaugcccucacuguggagaccggaccuuuuacgaucccgagccaauccugugccccugcuucaugccuaau

SEQ ID NO: 76619 - RNA, 426 nt, Artificial Sequence
  O15392 BIRC5
augggcgcccccacccugccuccagcuuggcagccguuccucaaggaccacagaaucagcacauuuaaaaacuggcccuuccuugaggggugcgcauguacuccugaaaggauggccgaggcgggauuuauucauugcccaacggaaaaugagcccgaucuggcucaauguuucuuuugcuucaaggaauuggaggguugggagccugacgaugacccaauagaagagcacaaaaagcauuccucuggcugugccuuuuuaucagugaaaaagcaguucgaagagcugacccuaggggaguuucucaagcuggaucgggaacgcgcaaaaaacaagaucgccaaagagacaaauaacaagaaaaaggaauucgaggaaacugcuaagaaaguccgacgugcaauugagcagcuugccgcuauggac

SEQ ID NO: 76620 - RNA, 945 nt, Artificial Sequence
  P43362 MAGA9
augagccuggagcagagauccccccacugcaagccugacgaagaucucgaggcccaaggcgaagaccuugggcugaugggagcucaggagccaaccggugaagaggaggaaacaacuucuucaagugauagcaaagaggaagagguguccgcagccggcucuucgucaccgccccagagcccucaggggggagcgaguuccucuaucagcgucuacuauacguuguggucccaauucgacgagggcucaaguagccaggaagaggaagagccaucuuccucaguugaucccgcucaguuagaauuuauguuccaggaggcccugaagcuaaaaguggcagagcucguacauuuucugcuucacaaguacagggugaaagaaccugucaccaaggccgagaugcuggaaagcgugauuaagaacuauaaacgguacuucccaguuauauuugguaaggcuagugaguucaugcaagugaucuuugggacagacgucaaagaaguggaucccgcaggacauucuuauauuuugguaacugcccucggccuguccugugacagcaugcugggcgaugggcacucgaugccuaaggcugcccucuuaaucauuguucugggagugauccuuaccaaagacaauugcgcgccagaggaggucauaugggaagcauugucugugauggguguguacgucggcaaggagcauauguucuauggggaaccgcgcaagcugcuaacacaggauuggguucaggagaacuaccucgaauaccgacaggugcccggauccgacccugcccacuaugaguuucuguggggcucaaaagcucacgccgagaccaguuacgaaaagguaaucaauuaucuugugaugcugaacgcacgugagccaauuuguuaccccagcuuguaugaagagguccucggugaggaacaagagggggug

SEQ ID NO: 76621 - RNA, 1119 nt, Artificial Sequence
  Q9UBF1 MAGC2
augcccccugugccaggcgucccguucagaaacguugacaaugauagccccaccuccguggagcuggaagacuggguagaugcccagcacccuacagacgaggaagaggaagaggcuucuucagcaaguagcacucucuaccuuguguuuuccccaucuucguucucaacgagcaguucccugaucuuggggggacccgaggaagaggaagucccuucuggugugauuccaaacuuaaccgagagcauacccuccucaccuccacaaggcccgccccaggggccuagucagagcccacugucuuccugcuguucaagcuuuaguuggucuuccuucagcgaggaaucgucuucccagaagggagaggauacaggcacuugccaaggucuacccgacucagaaaguagcuuuaccuauacacucgaugagaaaguugccgaacugguggaguuccuucuguugaaguacgaggcggaagagccugucaccgaagcugagaugcucaugaucgugauuaaauauaaggacuacuuuccaguaauccugaaaagggcccgggaauucauggagcugcucuuuggguuagcacugauugagguuggacccgaucauuucuguguguuugccaauacugucggccuuacagacgaaggcuccgaugacgaggggaugccggaaaacucuuugcugaucauaauccuaagcgugauuuucaucaagggaaauugcgcuucagaggaagugauuugggagguccucaacgcaguugguguguaugccggccgcgagcacuuuguauacggggaaccucgagagcugcuuaccaagguguggguccagggacauuaucuggaauaccgugaggugccccacaguuccccaccuuacuaugaguucuuguggggccccagagcucauagcgaaucuaucaaaaagaaaguucucgaguuccuggccaaguuaaauaacacggugccaucaaguuuucccagcugguacaaagaugcgcugaaggacgucgaagagagggugcaggcaacuauagacaccgccgaugacgcuacaguaauggccuccgaaucucucucgguuaugagcuccaaugugucauucagugag

SEQ ID NO: 76622 - RNA, 2463 nt, Artificial Sequence
  P21802 FGFR2
auggugagcuggggcagauucaucugccuggucguugugaccauggccacacucucccuugcuaggcccucuuuuucacugguagaggacacuacguuggaaccugaggaaccaccgaccaaguaccagauuagucaacccgagguguaugucgcagccccuggggaaagcuuagaggugcggugucugcuaaaagaugcggcuguuauauccuggacaaaggacggagugcaccucgguccaaacaaucgcacuguccugaucggcgaguaccuucagauuaaaggggccaccccccgagauucuggacuguaugcaugcacagccucgcguaccguggacucagaaacuugguacuucaugguaaacguuacagaugcuaucagcaguggcgacgaugaggacgauaccgacggugcagaagauuuuguguccgagaauucuaacaauaagagagccccuuauuggacgaacacugagaaaauggaaaagagguugcaugcugucccagccgcgaauaccgugaaguuccggugucccgcagggggaaacccuaugccaacaaugcgcuggcucaaaaauggcaaggaguuuaaacaggaacacagaauuggcggguacaaggugaggaaccagcauuggagccugaucauggaguccgucguuccgucagacaaaggaaauuauacuugcgugguagaaaacgaguacgguaguauaaaucacaccuaccaucuggauguggucgagcggagcccccaccgcccuauccuccaagccggcuuaccagcuaacgccucuacagugguugggggagacguggaauucgucuguaagguguauuccgacgcacagccccacauucaguggaucaagcauguagagaaaaauggcucaaaguacgguccugaugggcugccauaucuuaaaguuuugaaggcugccggagugaacaccacggacaaagaaauugagguccuguacauccgaaacgugacuuuugaagaugcgggcgaguauacaugccuagccggcaauagcauagggauuaguuuccacucugcauggcucaccguccugcccgcuccgggaagagagaaggaaaucacugccuccccugacuaccuugagauugcuaucuauuguaucgguguguuucugauugccugcaugguugugacaguaauauuguguaggaugaaaaacaccacgaagaagcccgauuucagcucgcagccagcaguccauaaacucaccaagcggaucccucugcgucgccaagugacaguuucugccgaauccucaaguagcaugaauuccaacacucccuuagugagaauuaccacaaggcugucuagcacugcugacaccccaaugcucgcgggcgucucagaguacgaacuucccgaggauccuaaaugggaguuuccacgggacaagcugacauuggggaaaccgcuaggagaaggcugcuucggucaggugguaauggcagaggccguggggaucgauaaggacaagcccaaagaagcuguuaccgucgccgugaagaugcugaaagaugacgcaacugagaaggaccucagugaucugguguccgagauggaaaugaugaaaaugauaggcaagcacaagaauauuaucaaccuucugggagccuguacgcaggacggcccuuuguacgucaucguugaguaugcuagcaaagggaaucuccgagaauaccugcgcgccagaaggccacccggaauggaguauucuuacgauauuaaccgggugccugaagagcagaugacauuuaaggacuuagugucaugcaccuaucaacuggcacgcgguauggaguaccuagcgagucagaaaugcauccacagagaucucgcugccaggaauguacuggucacugaaaacaaugugaugaagauugcagacuucggccuugcccgugauauaaacaauaucgacuauuacaaaaagaccacaaacgggcgguugccaguuaaguggauggcucccgaggcccuguucgaucgaguguacacccaucagagcgacgucugguccuuuggagugcucaugugggaaauuuucacucugggcgguucuccguauccugggaucccaguugaggaacuuuuuaaacuguugaaggagggccacagaauggauaaacccgcaaauuguacaaacgagcucuacaugaugaugagggacugcuggcaugcugugccuucgcaacgccccacguucaagcagcugguagaagauuuagaccggauccugacccuaacuacaaacgaggaauaucucgaccugagccagccacuugagcaguacuccccuucauaucccgauaccagaaguucuuguagcuccggagacgauucagucuuuagcccagacccgaugccuuacgaacccugcuugccacaauauccccacauuaauggcucugugaaaaca

SEQ ID NO: 76623 - RNA, 783 nt, Artificial Sequence
  P07288 KLK3
augugggugcccgucguuuuccugacccucagcgugacauggaucggcgccgcuccucuuauucuguccagaauaguagggggaugggagugcgaaaagcacucucagccauggcaaguguuggucgcaucaaggggucgggccguguguggcgggguuuuagugcauccgcaguggguccugacugcggcucacugcauccgcaacaaaagugugauucuacucggacgacauagccuguuucaccccgaggacacgggccagguauuccagguuucccauucuuuuccucacccacuuuacgauaugucgcuguugaagaaucguuuccucagacccggugacgauucaagccacgaccugaugcugcucagguuaagugaaccugccgagcugaccgaugcagugaaagucauggaccuuccaacacaagaacccgccuuggggacuaccuguuaugcuuccggauggggcucuaucgagccugaggaauuucugacaccaaagaaacuacagugcguggaucuccaugugauuagcaacgacgucugugcacagguucacccgcagaaggugaccaaguucaugcugugcgccggccgguggacugggggaaaauccacauguucaggugauaguggcgggccccuuguaugcaauggagugcugcaaggcaucaccagcugggguucugagccuugugcuuugccagaacgccccucccucuacacgaaggucgugcauuauagaaaauggauaaaggacacuaucguugccaacccu

SEQ ID NO: 76624 - RNA, 2250 nt, Artificial Sequence
  Q04609 FOLH1
auguggaaccugcuccacgagaccgacagcgccguggcuacagcaagaaggccccgguggcuuugcgccggcgcgcuggucuuggcugggggauucuuuuuacuggguuuccuauuuggcugguucaucaaguccucuaaugaagccacuaacauuacgccuaaacauaauaugaaggcauuucucgaugagcugaaagccgaaaacauaaagaaauuccuuuacaauuuuacccagaucccacaccuggcugggacagagcaaaacuuccaguuggcaaagcagauucagucacaauggaaggaauuuggacucgacaguguugagcuggcccauuaugaugugcugcucagcuacccgaauaaaacucaccccaacuauaucuccauuaucaaugaggacggcaacgaaauauucaauaccucuuuauuugagccuccacccccugguuacgaaaacguaucggauaucgugccacccuucucagcuuuuagcccucaggggaugccagagggagaccuggucuaugugaauuacgcccgcacagaggauuucuucaagcuugaacgagacaugaaaauuaacuguaguggcaagaucguuauugcgcguuauggcaaaguguuuagagggaauaaggucaagaacgcacaguuggccggagcuaaaggugugauccuguacuccgauccggccgacuacuucgcacccggcguaaagucuuauccugauggguggaaccuaccaggaggcgguguucagagggggaauauacucaaccugaauggagcuggcgacccccuuaccccuggcuacccagccaacgaguaugcguaccggcgcgggauugccgaagcagugggacugcccagcaucccgguccauccuauugguuauuacgaugcucaaaaauugcucgagaagaugggcggguccgcccccccagacucaaguuggagaggaagccugaaagugccuuauaaugugggccccgguuuuacugggaacuucucuacacagaaggucaaaaugcacauccacuccaccaaugaaguuacgaggaucuacaacgugauuggcacuuuacggggagcuguagagccagaccgcuacgugauacugggcgggcaucgagauucaugggucuuuggagguaucgacccccagagcggcgccgcagugguucacgagauugugagaaguuucgggacccucaagaaggaaggauggaggccucggcguacaauccuuuuugccucuugggaugcugaggaauucggccuguuggguuccacugagugggcggaagagaauagccgccuacugcaggagagaggggucgcauauauaaacgccgacucgucuauugaaggcaauuacacccucaggguggauugcacaccacugauguauucccuuguacauaaccugaccaaagaguugaagucaccggacgaaggauuugagggcaaaagucucuacgaaagcuggacgaagaaaucccccucuccugaguucagcgggaugccacggaucucaaagcugggaagugguaaugauuuugagguuuucuuucaacgauuaggcaucgcuuccgggcgcgccagauauacuaagaacugggaaacaaauaaauucagcggauacccccuguaucacucuguguacgagaccuacgaacuagucgagaaguucuaugacccuauguuuaaauaccaccucacuguggcacaggucaggggcgguaugguguucgagcuggccaacucaauuguucuuccauuugauugucgggacuaugcugugguauugcgcaaguacgccgauaaaaucuauaguauuagcaugaagcauccccaggaaaugaagacauacuccgucucuuucgacucgcuguuuagcgcagugaaaaacuucaccgagauagcguccaaguuuucagaaagacuccaagacuucgauaaaaguaauccgaucguucugaggaugaugaacgaccagcuuauguuucuggagcgugcuuucauugauccuuuggggcucccagaccggcccuuuuaucgacacgugaucuacgccccuucuagccauaauaaguacgcaggcgaauccuuccccggaaucuaugaugcccuguuugacauugagucaaaagucgauccaagcaaggcuuggggcgaggugaagagacagauauacguagccgcauucacggugcaggcugccgcggaaaccuuaucugagguugcc

SEQ ID NO: 76625 - protein, 34 aa, Artificial Sequence
  A0A5B9_145-178
TILYEILLGKATLYAVLVSALVLMAMVKRKDSRG

SEQ ID NO: 76626 - protein, 24 aa, Artificial Sequence
  B7Z8K6_131-154
LGLRMLFAKTVAVNFLLTAKLFFL

SEQ ID NO: 76627 - protein, 208 aa, Artificial Sequence
  O00206_632-839
TIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 76628 - protein, 62 aa, Artificial Sequence
  P01730_397-458
MALIVLGGVAGLLLFIGLGIFFCVRCRHRRRQAERMSQIKRLLSEKKTCQCPHRFQKTCSPI

SEQ ID NO: 76629 - protein, 27 aa, Artificial Sequence
  P01850_152-178
ILLGKATLYAVLVSALVLMAMVKRKDF

SEQ ID NO: 76630 - protein, 81 aa, Artificial Sequence
  P07766_127-207
VMSVATIVIVDICITGGLLLLVYYWSKNRKAKAKPVTRGAGAGGRQRGQNKERPPPVPNPDYEPIRKGQRDLYSGLNQRRI

SEQ ID NO: 76631 - protein, 729 aa, Artificial Sequence
  P08575_576-1304
ALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 76632 - protein, 46 aa, Artificial Sequence
  P08637_209-254
VSFCLVMVLLFAVDTGLYFSVKTNIRSSTRDWKDHKFKWRKDPQDK

SEQ ID NO: 76633 - protein, 68 aa, Artificial Sequence
  P10747_153-179
FWVLVVVGGVLACYSLLVTVAFIIFWVRSKRSRLLHSDYMNMTPRRPGPTRKHYQPYAPPRDFAAYRS

SEQ ID NO: 76634 - protein, 83 aa, Artificial Sequence
  P11912_144-226
IITAEGIILLFCAVVPGTLLLFRKRWQNEKLGLDAGDEYEDENLYEGLNLDDCSMYEDISRGLQGTYQDVGSLNIGDVQLEKP

SEQ ID NO: 76635 - protein, 265 aa, Artificial Sequence
  P15391_292-556
VSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 76636 - protein, 62 aa, Artificial Sequence
  P16410_162-223
FLLWILAAVSSGLFFYSFLLTAVSLSKMLKKRSPLTTGVYVKMPPTEPECEKQFQPYFIPIN

SEQ ID NO: 76637 - protein, 72 aa, Artificial Sequence
  P26718_1-72
MGWIRGRRSRHSWEMSEFHNYNLDLKKSDFSTRWQKQRCPVVKSKCRENASPFFFCCFIAVAMGIRFIIMVA

SEQ ID NO: 76638 - protein, 63 aa, Artificial Sequence
  P30273_24-86
LCYILDAILFLYGIVLTLLYCRLKIQVRKAAITSYEKSDGVYTGLSTRNQETYETLKHEKPPQ

SEQ ID NO: 76639 - protein, 70 aa, Artificial Sequence
  P40259_160-229
GIIMIQTLLIILFIIVPIFLLLDKDDSKAGMEEDHTYEGLDIDQTATYEDIVTLRTGEVKWSVGEHPGQE

SEQ ID NO: 76640 - protein, 82 aa, Artificial Sequence
  P42081_248-329
WITAVLPTVIICVMVFCLILWKWKKKKRPRNSYKCGTNTMEREESEQTKKREKIHIPERSDEAQRVFKSSKTSSCDKSDTCF

SEQ ID NO: 76641 - protein, 82 aa, Artificial Sequence
  Q15762_255-336
GGTVLLLLFVISITTIIVIFLNRRRRRERRDLFTESWDTQKAPNNYRSPISTSQPTNQSMDDTREDIYVNYPTFSRRPKTRV

SEQ ID NO: 76642 - protein, 100 aa, Artificial Sequence
  Q685J3_4393-4493
LVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 76643 - protein, 58 aa, Artificial Sequence
  Q9NNX6_1-58
MSDSKEPRLQQLGLLEEEQLRGLGFRQTRGYKSLAGCLGHGPLVLQLLSFTLLAGLLV

SEQ ID NO: 76644 - protein, 214 aa, Artificial Sequence
  Q9NR97_828-1041
AVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 76645 - protein, 33 aa, Artificial Sequence
  P16671_440-472
LLGLIEMILLSVGVVMFVAFMISYCACRSKTIK

SEQ ID NO: 76646 - protein, 39 aa, Artificial Sequence
  P32248_153-191
DRYVAIVQAVSAHRHRARVLLISKLSCVGIWILATVLSI

SEQ ID NO: 76647 - protein, 42 aa, Artificial Sequence
  P32248_248-289
RTLLQARNFERNKAIKVIIAVVVVFIVFQLPYNGVVLAQTVA

SEQ ID NO: 76648 - RNA, 105 nt, Artificial Sequence
  A0A5B9
accauccucuaugagaucuugcuagggaaggccaccuuguaugccgugcuggucagugcccucgugcugauggccauggucaagagaaaggauuccagaggcuag

SEQ ID NO: 76649 - RNA, 75 nt, Artificial Sequence
  B7Z8K6
cuugggcuacgaaugcuguuugcaaagacuguugccgucaauuuucucuugacugccaaguuauuuuucuuguaa

SEQ ID NO: 76650 - RNA, 627 nt, Artificial Sequence
  B9A064
accaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucuga

SEQ ID NO: 76651 - RNA, 189 nt, Artificial Sequence
  O00206
auggcccugauugugcuggggggcgucgccggccuccugcuuuucauugggcuaggcaucuucuucugugucaggugccggcaccgaaggcgccaagcagagcggaugucucagaucaagagacuccucagugagaagaagaccugccaguguccucaccgguuucagaagacauguagccccauuuga

SEQ ID NO: 76652 - RNA, 84 nt, Artificial Sequence
  P01730
auccugcuagggaaggccacccuguaugcugugcuggucagcgcccuuguguugauggccauggucaagagaaaggauuucuga

SEQ ID NO: 76653 - RNA, 246 nt, Artificial Sequence
  P01850
gugaugucgguggccacaauugucauaguggacaucugcaucacugggggcuugcugcugcugguuuacuacuggagcaagaauagaaaggccaaggccaagccugugacacgaggagcgggugcuggcggcaggcaaaggggacaaaacaaggagaggccaccaccuguucccaacccagacuaugagcccauccggaaaggccagcgggaccuguauucuggccugaaucagagacgcaucuga

SEQ ID NO: 76654 - RNA, 2190 nt, Artificial Sequence
  P07766
gcacugauagcauuucuggcauuucugauuauugugacaucaauagcccugcuuguuguucucuacaaaaucuaugaucuacauaagaaaagauccugcaauuuagaugaacagcaggagcuuguugaaagggaugaugaaaaacaacugaugaauguggagccaauccaugcagauauuuuguuggaaacuuauaagaggaagauugcugaugaaggaagacuuuuucuggcugaauuucagagcaucccgcggguguucagcaaguuuccuauaaaggaagcucgaaagcccuuuaaccagaauaaaaaccguuauguugacauucuuccuuaugauuauaaccguguugaacucucugagauaaacggagaugcagggucaaacuacauaaaugccagcuauauugaugguuucaaagaacccaggaaauacauugcugcacaaggucccagggaugaaacuguugaugauuucuggaggaugauuugggaacagaaagccacaguuauugucauggucacucgaugugaagaaggaaacaggaacaagugugcagaauacuggccgucaauggaagagggcacucgggcuuuuggagauguuguuguaaagaucaaccagcacaaaagauguccagauuacaucauucagaaauugaacauuguaaauaaaaaagaaaaagcaacuggaagagaggugacucacauucaguucaccagcuggccagaccacggggugccugaggauccucacuugcuccucaaacugagaaggagagugaaugccuucagcaauuucuucaguggucccauuguggugcacugcagugcugguguugggcgcacaggaaccuauaucggaauugaugccaugcuagaaggccuggaagccgagaacaaaguggauguuuaugguuauguugucaagcuaaggcgacagagaugccugaugguucaaguagaggcccaguacaucuugauccaucaggcuuugguggaauacaaucaguuuggagaaacagaagugaauuugucugaauuacauccauaucuacauaacaugaagaaaagggauccacccagugagccgucuccacuagaggcugaauuccagagacuuccuucauauaggagcuggaggacacagcacauuggaaaucaagaagaaaauaaaaguaaaaacaggaauucuaaugucaucccauaugacuauaacagagugccacuuaaacaugagcuggaaaugaguaaagagagugagcaugauucagaugaauccucugaugaugacagugauucagaggaaccaagcaaauacaucaaugcaucuuuuauaaugagcuacuggaaaccugaagugaugauugcugcucagggaccacugaaggagaccauuggugacuuuuggcagaugaucuuccaaagaaaagucaaaguuauuguuaugcugacagaacugaaacauggagaccaggaaaucugugcucaguacuggggagaaggaaagcaaacauauggagauauugaaguugaccugaaagacacagacaaaucuucaacuuauacccuucgugucuuugaacugagacauuccaagaggaaagacucucgaacuguguaccaguaccaauauacaaacuggaguguggagcagcuuccugcagaacccaaggaauuaaucucuaugauucaggucgucaaacaaaaacuuccccagaagaauuccucugaagggaacaagcaucacaagaguacaccucuacucauucacugcagggauggaucucagcaaacgggaauauuuugugcuuuguuaaaucucuuagaaagugcggaaacagaagagguaguggauauuuuucaagugguaaaagcucuacgcaaagcuaggccaggcaugguuuccacauucgagcaauaucaauuccuauaugacgucauugccagcaccuacccugcucagaauggacaaguaaagaaaaacaaccaucaagaagauaaaauugaauuugauaaugaaguggacaaaguaaagcaggaugcuaauuguguuaauccacuuggugccccagaaaagcucccugaagcaaaggaacaggcugaagguucugaacccacgaguggcacugaggggccagaacauucugucaaugguccugcaaguccagcuuuaaaucaagguucauag

SEQ ID NO: 76655 - RNA, 141 nt, Artificial Sequence
  P08575
gucucuuucugcuuggugaugguacuccuuuuugcaguggacacaggacuauauuucucugugaagacaaacauucgaagcucaacaagagacuggaaggaccauaaauuuaaauggagaaaggacccucaagacaaauga

SEQ ID NO: 76656 - RNA, 207 nt, Artificial Sequence
  P08637
uuuugggugcugguggugguugguggaguccuggcuugcuauagcuugcuaguaacaguggccuuuauuauuuucugggugaggaguaagaggagcaggcuccugcacagugacuacaugaacaugacuccccgccgccccgggcccacccgcaagcauuaccagcccuaugccccaccacgcgacuucgcagccuaucgcuccuga

SEQ ID NO: 76657 - RNA, 252 nt, Artificial Sequence
  P10747
aucaucacagccgaggggaucauccuccuguucugcgcgguggugccugggacgcugcugcuguucaggaaacgauggcagaacgagaagcucggguuggaugccggggaugaauaugaagaugaaaaccuuuaugaaggccugaaccuggacgacugcuccauguaugaggacaucucccggggccuccagggcaccuaccaggaugugggcagccucaacauaggagauguccagcuggagaagccguga

SEQ ID NO: 76658 - RNA, 798 nt, Artificial Sequence
  P11912
gucucagcugugacuuuggcuuaucugaucuucugccuguguucccuugugggcauucuucaucuucaaagagcccugguccugaggaggaaaagaaagcgaaugacugaccccaccaggagauucuucaaagugacgccucccccaggaagcgggccccagaaccaguacgggaacgugcugucucuccccacacccaccucaggccucggacgcgcccagcguugggccgcaggccuggggggcacugccccgucuuauggaaacccgagcagcgacguccaggcggauggagccuuggggucccggagcccgccgggagugggcccagaagaagaggaaggggagggcuaugaggaaccugacagugaggaggacuccgaguucuaugagaacgacuccaaccuugggcaggaccagcucucccaggauggcagcggcuacgagaacccugaggaugagccccuggguccugaggaugaagacuccuucuccaacgcugagucuuaugagaacgaggaugaagagcugacccagccggucgccaggacaauggacuuccugagcccucaugggucagccugggaccccagccgggaagcaaccucccuggggucccaguccuaugaggauaugagaggaauccuguaugcagccccccagcuccgcuccauucggggccagccuggacccaaucaugaggaagaugcagacucuuaugagaacauggauaaucccgaugggccagacccagccuggggaggagggggccgcaugggcaccuggagcaccagguga

SEQ ID NO: 76659 - RNA, 189 nt, Artificial Sequence
  P15391
uuccuccucuggauccuugcagcaguuaguucgggguuguuuuuuuauagcuuucuccucacagcuguuucuuugagcaaaaugcuaaagaaaagaagcccucuuacaacaggggucuaugugaaaaugcccccaacagagccagaaugugaaaagcaauuucagccuuauuuuauucccaucaauuga

SEQ ID NO: 76660 - RNA, 219 nt, Artificial Sequence
  P16410
augggguggauucguggucggaggucucgacacagcugggagaugagugaauuucauaauuauaacuuggaucugaagaagagugauuuuucaacacgauggcaaaagcaaagauguccaguagucaaaagcaaauguagagaaaaugcaucuccauuuuuuuucugcugcuucaucgcuguagccaugggaauccguuucauuauuaugguagcauga

SEQ ID NO: 76661 - RNA, 192 nt, Artificial Sequence
  P16671
cucugcuauauccuggaugccauccuguuucuguauggaauuguccucacccuccucuacugucgacugaagauccaagugcgaaaggcagcuauaaccagcuaugagaaaucagaugguguuuacacgggccugagcaccaggaaccaggagacuuacgagacucugaagcaugagaaaccaccacaguag

SEQ ID NO: 76662 - RNA, 213 nt, Artificial Sequence
  P26718
gguaucaucaugauccagacgcugcugaucauccucuucaucaucgugccuaucuuccugcugcuggacaaggaugacagcaaggcuggcauggaggaagaucacaccuacgagggccuggacauugaccagacagccaccuaugaggacauagugacgcugcggacaggggaagugaaguggucuguaggugagcacccaggccaggaguga

SEQ ID NO: 76663 - RNA, 249 nt, Artificial Sequence
  P30273
uggauuacagcuguacuuccaacaguuauuauaugugugaugguuuucugucuaauucuauggaaauggaagaagaagaagcggccucgcaacucuuauaaauguggaaccaacacaauggagagggaagagagugaacagaccaagaaaagagaaaaaauccauauaccugaaagaucugaugaagcccagcguguuuuuaaaaguucgaagacaucuucaugcgacaaaagugauacauguuuuuaa

SEQ ID NO: 76664 - RNA, 249 nt, Artificial Sequence
  P32248
ggagggacaguuuuauuguuguuguuuguuaucucaauuaccaccaucauugucauuuuccuuaacagaaggagaaggagagagagaagagaucuauuuacagaguccugggauacacagaaggcacccaauaacuauagaagucccaucucuaccagucaaccuaccaaucaauccauggaugauacaagagaggauauuuaugucaacuauccaaccuucucucgcagaccaaagacuagaguuuaa

SEQ ID NO: 76665 - RNA, 303 nt, Artificial Sequence
  P40259
cucgugggggcaggggucgugcugaugcugaucauccugguagcucuccugaugcucguuuuccgcuccaagagagaggugaaacggcaaaaguacagauugucucaguuauacaaguggcaagaagaggacaguggaccagcuccugggaccuuccaaaacauuggcuuugacaucugccaagaugaugauuccauccaccuggaguccaucuauaguaauuuccagcccuccuugagacacauagacccugaaacaaagauccgaauucagaggccucagguaaugacgacaucauuuuaa

SEQ ID NO: 76666 - RNA, 177 nt, Artificial Sequence
  P42081
augagugacuccaaggaaccaagacugcagcagcugggccuccuggaggaggaacagcugagaggccuuggauuccgacagacucgaggauacaagagcuuagcagggugucuuggccaugguccccuggugcugcaacuccucuccuucacgcucuuggcugggcuccuugucuga

SEQ ID NO: 76667 - RNA, 645 nt, Artificial Sequence
  Q15762
gcagugauauuauuuuucuucacguucuuuaucaccaccaugguuauguuggcugcccuggcucaccauuuguuuuacugggauguuugguuuauauauaauguguguuuagcuaagguaaaaggcuacaggucucuuuccacaucccaaacuuucuaugaugcuuacauuucuuaugacaccaaagaugccucuguuacugacugggugauaaaugagcugcgcuaccaccuugaagagagccgagacaaaaacguucuccuuugucuagaggagagggauugggacccgggauuggccaucaucgacaaccucaugcagagcaucaaccaaagcaagaaaacaguauuuguuuuaaccaaaaaauaugcaaaaagcuggaacuuuaaaacagcuuuuuacuuggcuuugcagaggcuaauggaugagaacauggaugugauuauauuuauccugcuggagccaguguuacagcauucucaguauuugaggcuacggcagcggaucuguaagagcuccauccuccaguggccugacaacccgaaggcagaaggcuuguuuuggcaaacucugagaaauguggucuugacugaaaaugauucacgguauaacaauauguaugucgauuccauuaagcaauacuaa

SEQ ID NO: 76668 - RNA, 102 nt, Artificial Sequence
  Q685J3
cuccuuggccugauagaaaugaucuuacucaguguugguguggugauguuuguugcuuuuaugauuucauauugugcaugcagaucgaaaacaauaaaauaa

SEQ ID NO: 76669 - RNA, 120 nt, Artificial Sequence
  Q9NNX6
gaccgcuacguggccaucguccaggcugucucagcucaccgccaccgugcccgcguccuucucaucagcaagcuguccugugugggcaucuggauacuagccacagugcucuccaucuga

SEQ ID NO: 76670 - RNA, 129 nt, Artificial Sequence
  Q9NR97
cgcacccugcuccaggcacgcaacuuugagcgcaacaaggccaucaaggugaucaucgcuguggucguggucuucauagucuuccagcugcccuacaauggggugguccuggcccagacgguggccuga

SEQ ID NO: 76671 - RNA, 105 nt, Artificial Sequence
  A0A5B9
accauccuguacgagauccuccugggcaaggccacccuguacgccgugcucgucagcgcgcuggugcugauggccauggugaagcgcaaggacucccggggguga

SEQ ID NO: 76672 - RNA, 75 nt, Artificial Sequence
  B7Z8K6
cugggccuccgcaugcuguucgccaagaccguggccgucaacuuccugcucaccgcgaagcuguucuuccuguga

SEQ ID NO: 76673 - RNA, 627 nt, Artificial Sequence
  B9A064
accaucaucggcgugagcguccuguccgugcucguggucagcgugguggccguccugguguacaaguucuacuuccaccugaugcuccuggccgggugcaucaaguacggccgcggggagaacaucuacgacgcguucgugaucuacuccagccaggacgaggacuggguccggaacgagcuggugaagaaccucgaggagggcgugcccccguuccagcugugccugcacuaccgcgacuucauccccggggucgccaucgccgccaacaucauccacgagggcuuccacaagucccggaaggugaucguggucgugagccagcacuucauccagucccgcuggugcaucuucgaguacgagaucgcccagaccuggcaguuccucagcucccgggcgggcaucaucuucaucgugcugcagaaggucgagaagacgcugcuccgccagcaggucgagcuguaccggcugcucagccgcaacaccuaccuggagugggaggacuccgugcuggggcggcacaucuucuggcgccggcuccgcaaggcccugcuggacggcaagagcuggaaccccgaggggaccgugggcaccgggugcaacuggcaggaggccacguccaucuga

SEQ ID NO: 76674 - RNA, 189 nt, Artificial Sequence
  O00206
auggcccugaucgugcucggcggggucgccggccugcuccuguucaucgggcugggcaucuucuucugcgugcgcugccggcaccgccggcgccaggcggagcggaugagccagaucaagcgccugcucuccgagaagaagaccugccagugcccccaccgguuccagaagaccugcagcccgaucuga

SEQ ID NO: 76675 - RNA, 84 nt, Artificial Sequence
  P01730
auccugcucggcaaggccacccuguacgccgugcuggucagcgcgcucgugcugauggccauggugaagcgcaaggacuucuga

SEQ ID NO: 76676 - RNA, 246 nt, Artificial Sequence
  P01850
gugaugagcgucgccaccaucgugaucguggacaucugcaucaccggcgggcugcuccugcuggucuacuacugguccaagaaccgcaaggccaaggcgaagcccgugacgcggggcgccggggccggcgggcgccagcggggccagaacaaggagcgcccgccgcccgugcccaaccccgacuacgagcccauccggaagggccagcgcgaccucuacagcgggcugaaccagcggcgcaucuga

SEQ ID NO: 76677 - RNA, 2190 nt, Artificial Sequence
  P07766
gcccugaucgccuuccucgcguuccugaucaucgugaccagcaucgcccugcucgucgugcuguacaagaucuacgaccugcacaagaagcgcuccugcaaccucgacgagcagcaggagcugguggagcgggacgacgagaagcagcugaugaacgucgagcccauccacgccgacauccuccuggagaccuacaagcgcaagaucgccgacgagggccggcuguuccucgccgaguuccagagcaucccgcgcguguucuccaaguuccccaucaaggaggcgcggaagcccuucaaccagaacaagaaccgcuacguggacauccugcccuacgacuacaaccgggucgagcugagcgagaucaacggggacgccggcuccaacuacaucaacgccagcuacaucgacggguucaaggagccgcgcaaguacaucgccgcgcagggcccccgggacgagacgguggacgacuucuggcgcaugaucugggagcagaaggccaccgugaucgucauggugacccggugcgaggaggggaaccgcaacaagugcgccgaguacuggcccuccauggaggagggcacccgggccuucggcgacguggucgugaagaucaaccagcacaagcgcugccccgacuacaucauccagaagcucaacaucgugaacaagaaggagaaggccacggggcgggaggucacccacauccaguucaccagcuggccggaccacggcgugcccgaggacccccaccuccugcugaagcugcgccggcgcgugaacgcguucuccaacuucuucagcgggcccaucgucgugcacugcuccgccggcguggggcggaccggcacguacaucggcaucgacgccaugcuggaggggcucgaggccgagaacaaggucgacguguacggcuacguggucaagcugcgccggcagcgcugccugauggugcaggucgaggcccaguacauccucauccaccaggcgcugguggaguacaaccaguucggggagaccgaggugaaccugagcgagcuccacccguaccugcacaacaugaagaagcgcgacccgcccuccgagcccagcccccuggaggccgaguuccagcggcuccccuccuaccgcagcuggcggacccagcacaucggcaaccaggaggagaacaaguccaagaaccgcaacagcaacgucauccccuacgacuacaaccgggugccccugaagcacgagcuggagauguccaaggagagcgagcacgacagcgacgaguccagcgacgacgacuccgacagcgaggagccguccaaguacaucaacgccagcuucaucauguccuacuggaagcccgaggugaugaucgccgcccagggcccccucaaggagaccaucggggacuucuggcagaugaucuuccagcgcaaggucaaggugaucgugaugcugacggagcugaagcacggcgaccaggagaucugcgcgcaguacuggggcgaggggaagcagaccuacggggacaucgaggucgaccucaaggacaccgacaagagcuccaccuacacgcugcggguguucgagcugcgccacagcaagcggaaggacucccgcaccguguaccaguaccaguacaccaacuggagcgucgagcagcuccccgccgagccgaaggagcugaucuccaugauccagguggugaagcagaagcugccccagaagaacagcuccgagggcaacaagcaccacaagagcacgccccuccugauccacugccgggacggcucccagcagaccgggaucuucugcgcccugcucaaccugcuggagagcgccgagaccgaggaggucguggacaucuuccagguggucaaggcccuccgcaaggcgcggcccggcaugguguccaccuucgagcaguaccaguuccuguacgacgugaucgccagcaccuacccggcccagaacgggcaggucaagaagaacaaccaccaggaggacaagaucgaguucgacaacgagguggacaaggugaagcaggacgccaacugcgucaacccccugggcgcgcccgagaagcugccggaggccaaggagcaggccgaggggagcgagcccacguccggcaccgagggccccgagcacagcgugaacgggcccgccuccccggcccucaaccagggcagcuga

SEQ ID NO: 76678 - RNA, 141 nt, Artificial Sequence
  P08575
gugagcuucugccuggucauggugcuccuguucgccguggacaccggccuguacuucuccgucaagaccaacauccgcagcuccacgcgggacuggaaggaccacaaguucaaguggcgcaaggacccccaggacaaguga

SEQ ID NO: 76679 - RNA, 207 nt, Artificial Sequence
  P08637
uucugggugcuggucguggugggcgggguccucgccugcuacagccugcuggugaccguggccuucaucaucuucuggguccgcuccaagcggagccgccuccugcacuccgacuacaugaacaugacgccccggcgcccgggccccacccggaagcacuaccagcccuacgcgcccccgcgcgacuucgccgccuaccggagcuga

SEQ ID NO: 76680 - RNA, 252 nt, Artificial Sequence
  P10747
aucaucaccgccgagggcaucauccugcuguucugcgccgugguccccgggacccugcuccucuuccgcaagcgguggcagaacgagaagcugggccuggacgcgggggacgaguacgaggacgagaaccucuacgagggccugaaccuggacgacugcagcauguacgaggacaucucccgcgggcuccagggcacguaccaggacgugggcagccugaacaucggggacgugcagcuggagaagccguga

SEQ ID NO: 76681 - RNA, 798 nt, Artificial Sequence
  P11912
gugagcgccgucacccuggccuaccucaucuucugccugugcucccuggugggcauccuccaccuccagcgcgcgcuggugcugcggcgcaagcggaagcgcaugaccgaccccacgcggcgcuucuucaaggucaccccgccgcccgggagcggcccccagaaccaguacgggaacgugcugucccugcccacccccaccagcggccucgggcgggcccagcgcugggccgccggccugggcgggacggcccccuccuacggcaaccccagcuccgacgugcaggcggacggggcccugggcagccgguccccgcccggggucggccccgaggaggaggagggcgagggguacgaggagcccgacagcgaggaggacuccgaguucuacgagaacgacagcaaccucggccaggaccagcugucccaggacgggagcggcuacgagaacccggaggacgagccccugggccccgaggacgaggacuccuucagcaacgccgaguccuacgagaacgaggacgaggagcucacccagcccguggcccgcaccauggacuuccugagcccgcacggguccgcgugggaccccagccgggaggccaccagccugggcucccagagcuacgaggacaugcgcgggauccucuacgccgcgccccagcugcgguccauccgcggccagcccgggccgaaccacgaggaggacgccgacagcuacgagaacauggacaaccccgacggccccgaccccgccuggggcgggggcgggcggaugggcacgugguccacccgcuga

SEQ ID NO: 76682 - RNA, 189 nt, Artificial Sequence
  P15391
uuccugcucuggauccuggccgccguguccuccggccuguucuucuacagcuuccuccugaccgcggucucccugagcaagaugcucaagaagcgcagcccccugaccacggggguguacgugaagaugccgcccaccgagcccgagugcgagaagcaguuccagcccuacuucaucccgaucaacuga

SEQ ID NO: 76683 - RNA, 219 nt, Artificial Sequence
  P16410
augggcuggauccgcgggcggcgcagccggcacuccugggagaugagcgaguuccacaacuacaaccuggaccucaagaaguccgacuucagcacccgcuggcagaagcagcggugccccguggucaaguccaagugccgcgagaacgccagcccguucuucuucugcugcuucaucgccguggcgaugggcauccgguucaucaucaugguggccuga

SEQ ID NO: 76684 - RNA, 192 nt, Artificial Sequence
  P16671
cugugcuacauccucgacgccauccuguuccuguacggcaucgugcucacccugcuguacugccgccucaagauccagguccggaaggccgcgaucaccagcuacgagaaguccgacgggguguacacgggccugagcacccgcaaccaggagaccuacgagacccugaagcacgagaagcccccgcaguga

SEQ ID NO: 76685 - RNA, 213 nt, Artificial Sequence
  P26718
ggcaucaucaugauccagacccugcucaucauccuguucaucaucgugcccaucuuccugcuccuggacaaggacgacagcaaggccgggauggaggaggaccacaccuacgagggccuggacaucgaccagacggccaccuacgaggacaucgucacccuccgcaccggggaggugaagugguccgugggcgagcacccggggcaggaguga

SEQ ID NO: 76686 - RNA, 249 nt, Artificial Sequence
  P30273
uggaucaccgccgugcugcccaccgucaucaucugcgugaugguguucugccucauccuguggaaguggaagaagaagaagcgcccgcggaacagcuacaagugcggcacgaacaccauggagcgcgaggaguccgagcagaccaagaagcgggagaagauccacauccccgagcgcagcgacgaggcccagcgggucuucaaguccagcaagaccuccagcugcgacaaguccgacacgugcuucuga

SEQ ID NO: 76687 - RNA, 249 nt, Artificial Sequence
  P32248
ggcgggaccgugcugcuccugcuguucgucaucagcaucaccacgaucaucgugaucuuccucaaccgccggcgccggcgcgagcggcgcgaccuguucaccgaguccugggacacccagaaggcccccaacaacuaccggagcccgaucuccaccagccagcccacgaaccaguccauggacgacacccgcgaggacaucuacgugaacuaccccaccuucagccggcgccccaagacccgggucuga

SEQ ID NO: 76688 - RNA, 303 nt, Artificial Sequence
  P40259
cuggugggcgccggggucgugcucaugcugaucauccugguggcccuccugaugcuggucuuccgcagcaagcgggaggugaagcgccagaaguaccggcucucccagcuguacaaguggcaggaggaggacagcggccccgcgccggggaccuuccagaacaucggcuucgacaucugccaggacgacgacuccauccaccuggagagcaucuacuccaacuuccagcccagccuccgccacaucgaccccgagaccaagauccggauccagcgcccccaggugaugacgaccuccuucuga

SEQ ID NO: 76689 - RNA, 177 nt, Artificial Sequence
  P42081
augagcgacuccaaggagccccgccugcagcagcucggccugcuggaggaggagcagcuccgggggcugggcuuccgccagacccggggguacaagagccuggccggcugccucgggcacggcccgcuggugcugcagcuccuguccuucacccugcucgccggccugcuggucuga

SEQ ID NO: 76690 - RNA, 645 nt, Artificial Sequence
  Q15762
gccgugauccuguucuucuucaccuucuucaucaccacgauggucaugcucgccgcgcuggcccaccaccuguucuacugggacgugugguucaucuacaacgugugccucgccaaggucaagggcuaccgcagccuguccaccagccagaccuucuacgacgccuacaucuccuacgacaccaaggacgccagcgugacggacugggugaucaacgagcugcgguaccaccucgaggagucccgcgacaagaacguccugcugugccucgaggagcgggacugggaccccgggcuggcgaucaucgacaaccugaugcagagcaucaaccaguccaagaagaccguguucgugcucaccaagaaguacgccaagagcuggaacuucaagaccgccuucuaccuggcccugcagcgccucauggacgagaacauggacgucaucaucuucauccugcuggagccggugcuccagcacucccaguaccugcggcugcgccagcggaucugcaagagcuccauccuccaguggcccgacaaccccaaggcggagggccuguucuggcagacgcugcgcaacgugguccucaccgagaacgacagccgguacaacaacauguacguggacuccaucaagcaguacuga

SEQ ID NO: 76691 - RNA, 102 nt, Artificial Sequence
  Q685J3
cugcucggccugaucgagaugauccugcucagcgugggggucgugauguucguggccuucaugaucuccuacugcgccugccgcagcaagaccaucaaguga

SEQ ID NO: 76692 - RNA, 120 nt, Artificial Sequence
  Q9NNX6
gaccgcuacguggccaucguccaggccgugagcgcgcaccggcaccgcgcccgggugcugcucaucuccaagcugagcugcgucggcaucuggauccuggccaccgugcucuccaucuga

SEQ ID NO: 76693 - RNA, 129 nt, Artificial Sequence
  Q9NR97
cgcacccugcuccaggcccggaacuucgagcgcaacaaggccaucaaggugaucaucgcggucgugguggucuucaucguguuccagcugcccuacaacggcgugguccuggcccagaccguggccuga

SEQ ID NO: 76694 - RNA, 105 nt, Artificial Sequence
  A0A5B9
accauccucuacgagauccuccucggcaaggccacccucuacgccguccucgucuccgcccucguccucauggccauggucaagcgcaaggacucccgcggcuga

SEQ ID NO: 76695 - RNA, 75 nt, Artificial Sequence
  B7Z8K6
cucggccuccgcaugcucuucgccaagaccgucgccgucaacuuccuccucaccgccaagcucuucuuccucuga

SEQ ID NO: 76696 - RNA, 627 nt, Artificial Sequence
  B9A064
accaucaucggcgucuccguccucuccguccucgucgucuccgucgucgccguccucgucuacaaguucuacuuccaccucaugcuccucgccggcugcaucaaguacggccgcggcgagaacaucuacgacgccuucgucaucuacuccucccaggacgaggacuggguccgcaacgagcucgucaagaaccucgaggagggcgucccccccuuccagcucugccuccacuaccgcgacuucauccccggcgucgccaucgccgccaacaucauccacgagggcuuccacaagucccgcaaggucaucgucgucgucucccagcacuucauccagucccgcuggugcaucuucgaguacgagaucgcccagaccuggcaguuccucuccucccgcgccggcaucaucuucaucguccuccagaaggucgagaagacccuccuccgccagcaggucgagcucuaccgccuccucucccgcaacaccuaccucgagugggaggacuccguccucggccgccacaucuucuggcgccgccuccgcaaggcccuccucgacggcaaguccuggaaccccgagggcaccgucggcaccggcugcaacuggcaggaggccaccuccaucuga

SEQ ID NO: 76697 - RNA, 189 nt, Artificial Sequence
  O00206
auggcccucaucguccucggcggcgucgccggccuccuccucuucaucggccucggcaucuucuucugcguccgcugccgccaccgccgccgccaggccgagcgcaugucccagaucaagcgccuccucuccgagaagaagaccugccagugcccccaccgcuuccagaagaccugcucccccaucuga

SEQ ID NO: 76698 - RNA, 84 nt, Artificial Sequence
  P01730
auccuccucggcaaggccacccucuacgccguccucgucuccgcccucguccucauggccauggucaagcgcaaggacuucuga

SEQ ID NO: 76699 - RNA, 246 nt, Artificial Sequence
  P01850
gucauguccgucgccaccaucgucaucgucgacaucugcaucaccggcggccuccuccuccucgucuacuacugguccaagaaccgcaaggccaaggccaagcccgucacccgcggcgccggcgccggcggccgccagcgcggccagaacaaggagcgccccccccccguccccaaccccgacuacgagcccauccgcaagggccagcgcgaccucuacuccggccucaaccagcgccgcaucuga

SEQ ID NO: 76700 - RNA, 2190 nt, Artificial Sequence
  P07766
gcccucaucgccuuccucgccuuccucaucaucgucaccuccaucgcccuccucgucguccucuacaagaucuacgaccuccacaagaagcgcuccugcaaccucgacgagcagcaggagcucgucgagcgcgacgacgagaagcagcucaugaacgucgagcccauccacgccgacauccuccucgagaccuacaagcgcaagaucgccgacgagggccgccucuuccucgccgaguuccaguccaucccccgcgucuucuccaaguuccccaucaaggaggcccgcaagcccuucaaccagaacaagaaccgcuacgucgacauccuccccuacgacuacaaccgcgucgagcucuccgagaucaacggcgacgccggcuccaacuacaucaacgccuccuacaucgacggcuucaaggagccccgcaaguacaucgccgcccagggcccccgcgacgagaccgucgacgacuucuggcgcaugaucugggagcagaaggccaccgucaucgucauggucacccgcugcgaggagggcaaccgcaacaagugcgccgaguacuggcccuccauggaggagggcacccgcgccuucggcgacgucgucgucaagaucaaccagcacaagcgcugccccgacuacaucauccagaagcucaacaucgucaacaagaaggagaaggccaccggccgcgaggucacccacauccaguucaccuccuggcccgaccacggcguccccgaggacccccaccuccuccucaagcuccgccgccgcgucaacgccuucuccaacuucuucuccggccccaucgucguccacugcuccgccggcgucggccgcaccggcaccuacaucggcaucgacgccaugcucgagggccucgaggccgagaacaaggucgacgucuacggcuacgucgucaagcuccgccgccagcgcugccucaugguccaggucgaggcccaguacauccucauccaccaggcccucgucgaguacaaccaguucggcgagaccgaggucaaccucuccgagcuccaccccuaccuccacaacaugaagaagcgcgacccccccuccgagcccuccccccucgaggccgaguuccagcgccuccccuccuaccgcuccuggcgcacccagcacaucggcaaccaggaggagaacaaguccaagaaccgcaacuccaacgucauccccuacgacuacaaccgcgucccccucaagcacgagcucgagauguccaaggaguccgagcacgacuccgacgaguccuccgacgacgacuccgacuccgaggagcccuccaaguacaucaacgccuccuucaucauguccuacuggaagcccgaggucaugaucgccgcccagggcccccucaaggagaccaucggcgacuucuggcagaugaucuuccagcgcaaggucaaggucaucgucaugcucaccgagcucaagcacggcgaccaggagaucugcgcccaguacuggggcgagggcaagcagaccuacggcgacaucgaggucgaccucaaggacaccgacaaguccuccaccuacacccuccgcgucuucgagcuccgccacuccaagcgcaaggacucccgcaccgucuaccaguaccaguacaccaacugguccgucgagcagcuccccgccgagcccaaggagcucaucuccaugauccaggucgucaagcagaagcucccccagaagaacuccuccgagggcaacaagcaccacaaguccaccccccuccucauccacugccgcgacggcucccagcagaccggcaucuucugcgcccuccucaaccuccucgaguccgccgagaccgaggaggucgucgacaucuuccaggucgucaaggcccuccgcaaggcccgccccggcauggucuccaccuucgagcaguaccaguuccucuacgacgucaucgccuccaccuaccccgcccagaacggccaggucaagaagaacaaccaccaggaggacaagaucgaguucgacaacgaggucgacaaggucaagcaggacgccaacugcgucaacccccucggcgcccccgagaagcuccccgaggccaaggagcaggccgagggcuccgagcccaccuccggcaccgagggccccgagcacuccgucaacggccccgccucccccgcccucaaccagggcuccuga

SEQ ID NO: 76701 - RNA, 141 nt, Artificial Sequence
  P08575
gucuccuucugccucgucaugguccuccucuucgccgucgacaccggccucuacuucuccgucaagaccaacauccgcuccuccacccgcgacuggaaggaccacaaguucaaguggcgcaaggacccccaggacaaguga

SEQ ID NO: 76702 - RNA, 207 nt, Artificial Sequence
  P08637
uucuggguccucgucgucgucggcggcguccucgccugcuacucccuccucgucaccgucgccuucaucaucuucuggguccgcuccaagcgcucccgccuccuccacuccgacuacaugaacaugaccccccgccgccccggccccacccgcaagcacuaccagcccuacgcccccccccgcgacuucgccgccuaccgcuccuga

SEQ ID NO: 76703 - RNA, 252 nt, Artificial Sequence
  P10747
aucaucaccgccgagggcaucauccuccucuucugcgccgucguccccggcacccuccuccucuuccgcaagcgcuggcagaacgagaagcucggccucgacgccggcgacgaguacgaggacgagaaccucuacgagggccucaaccucgacgacugcuccauguacgaggacaucucccgcggccuccagggcaccuaccaggacgucggcucccucaacaucggcgacguccagcucgagaagcccuga

SEQ ID NO: 76704 - RNA, 798 nt, Artificial Sequence
  P11912
gucuccgccgucacccucgccuaccucaucuucugccucugcucccucgucggcauccuccaccuccagcgcgcccucguccuccgccgcaagcgcaagcgcaugaccgaccccacccgccgcuucuucaaggucacccccccccccggcuccggcccccagaaccaguacggcaacguccucucccuccccacccccaccuccggccucggccgcgcccagcgcugggccgccggccucggcggcaccgcccccuccuacggcaaccccuccuccgacguccaggccgacggcgcccucggcucccgcuccccccccggcgucggccccgaggaggaggagggcgagggcuacgaggagcccgacuccgaggaggacuccgaguucuacgagaacgacuccaaccucggccaggaccagcucucccaggacggcuccggcuacgagaaccccgaggacgagccccucggccccgaggacgaggacuccuucuccaacgccgaguccuacgagaacgaggacgaggagcucacccagcccgucgcccgcaccauggacuuccucuccccccacggcuccgccugggaccccucccgcgaggccaccucccucggcucccaguccuacgaggacaugcgcggcauccucuacgccgccccccagcuccgcuccauccgcggccagcccggccccaaccacgaggaggacgccgacuccuacgagaacauggacaaccccgacggccccgaccccgccuggggcggcggcggccgcaugggcaccugguccacccgcuga

SEQ ID NO: 76705 - RNA, 189 nt, Artificial Sequence
  P15391
uuccuccucuggauccucgccgccgucuccuccggccucuucuucuacuccuuccuccucaccgccgucucccucuccaagaugcucaagaagcgcuccccccucaccaccggcgucuacgucaagaugccccccaccgagcccgagugcgagaagcaguuccagcccuacuucauccccaucaacuga

SEQ ID NO: 76706 - RNA, 219 nt, Artificial Sequence
  P16410
augggcuggauccgcggccgccgcucccgccacuccugggagauguccgaguuccacaacuacaaccucgaccucaagaaguccgacuucuccacccgcuggcagaagcagcgcugccccgucgucaaguccaagugccgcgagaacgccucccccuucuucuucugcugcuucaucgccgucgccaugggcauccgcuucaucaucauggucgccuga

SEQ ID NO: 76707 - RNA, 192 nt, Artificial Sequence
  P16671
cucugcuacauccucgacgccauccucuuccucuacggcaucguccucacccuccucuacugccgccucaagauccagguccgcaaggccgccaucaccuccuacgagaaguccgacggcgucuacaccggccucuccacccgcaaccaggagaccuacgagacccucaagcacgagaagcccccccaguga

SEQ ID NO: 76708 - RNA, 213 nt, Artificial Sequence
  P26718
ggcaucaucaugauccagacccuccucaucauccucuucaucaucguccccaucuuccuccuccucgacaaggacgacuccaaggccggcauggaggaggaccacaccuacgagggccucgacaucgaccagaccgccaccuacgaggacaucgucacccuccgcaccggcgaggucaagugguccgucggcgagcaccccggccaggaguga

SEQ ID NO: 76709 - RNA, 249 nt, Artificial Sequence
  P30273
uggaucaccgccguccuccccaccgucaucaucugcgucauggucuucugccucauccucuggaaguggaagaagaagaagcgcccccgcaacuccuacaagugcggcaccaacaccauggagcgcgaggaguccgagcagaccaagaagcgcgagaagauccacauccccgagcgcuccgacgaggcccagcgcgucuucaaguccuccaagaccuccuccugcgacaaguccgacaccugcuucuga

SEQ ID NO: 76710 - RNA, 249 nt, Artificial Sequence
  P32248
ggcggcaccguccuccuccuccucuucgucaucuccaucaccaccaucaucgucaucuuccucaaccgccgccgccgccgcgagcgccgcgaccucuucaccgaguccugggacacccagaaggcccccaacaacuaccgcucccccaucuccaccucccagcccaccaaccaguccauggacgacacccgcgaggacaucuacgucaacuaccccaccuucucccgccgccccaagacccgcgucuga

SEQ ID NO: 76711 - RNA, 303 nt, Artificial Sequence
  P40259
cucgucggcgccggcgucguccucaugcucaucauccucgucgcccuccucaugcucgucuuccgcuccaagcgcgaggucaagcgccagaaguaccgccucucccagcucuacaaguggcaggaggaggacuccggccccgcccccggcaccuuccagaacaucggcuucgacaucugccaggacgacgacuccauccaccucgaguccaucuacuccaacuuccagcccucccuccgccacaucgaccccgagaccaagauccgcauccagcgcccccaggucaugaccaccuccuucuga

SEQ ID NO: 76712 - RNA, 177 nt, Artificial Sequence
  P42081
auguccgacuccaaggagccccgccuccagcagcucggccuccucgaggaggagcagcuccgcggccucggcuuccgccagacccgcggcuacaagucccucgccggcugccucggccacggcccccucguccuccagcuccucuccuucacccuccucgccggccuccucgucuga

SEQ ID NO: 76713 - RNA, 645 nt, Artificial Sequence
  Q15762
gccgucauccucuucuucuucaccuucuucaucaccaccauggucaugcucgccgcccucgcccaccaccucuucuacugggacgucugguucaucuacaacgucugccucgccaaggucaagggcuaccgcucccucuccaccucccagaccuucuacgacgccuacaucuccuacgacaccaaggacgccuccgucaccgacugggucaucaacgagcuccgcuaccaccucgaggagucccgcgacaagaacguccuccucugccucgaggagcgcgacugggaccccggccucgccaucaucgacaaccucaugcaguccaucaaccaguccaagaagaccgucuucguccucaccaagaaguacgccaaguccuggaacuucaagaccgccuucuaccucgcccuccagcgccucauggacgagaacauggacgucaucaucuucauccuccucgagcccguccuccagcacucccaguaccuccgccuccgccagcgcaucugcaaguccuccauccuccaguggcccgacaaccccaaggccgagggccucuucuggcagacccuccgcaacgucguccucaccgagaacgacucccgcuacaacaacauguacgucgacuccaucaagcaguacuga

SEQ ID NO: 76714 - RNA, 102 nt, Artificial Sequence
  Q685J3
cuccucggccucaucgagaugauccuccucuccgucggcgucgucauguucgucgccuucaugaucuccuacugcgccugccgcuccaagaccaucaaguga

SEQ ID NO: 76715 - RNA, 120 nt, Artificial Sequence
  Q9NNX6
gaccgcuacgucgccaucguccaggccgucuccgcccaccgccaccgcgcccgcguccuccucaucuccaagcucuccugcgucggcaucuggauccucgccaccguccucuccaucuga

SEQ ID NO: 76716 - RNA, 129 nt, Artificial Sequence
  Q9NR97
cgcacccuccuccaggcccgcaacuucgagcgcaacaaggccaucaaggucaucaucgccgucgucgucgucuucaucgucuuccagcuccccuacaacggcgucguccucgcccagaccgucgccuga

SEQ ID NO: 76717 - RNA, 105 nt, Artificial Sequence
  A0A5B9
accauccuguacgagauucuccuuggcaaggccacacuguaugcuguguuggucagcgcauuaguucugauggccauggugaaaagaaaggacuccaggggguga

SEQ ID NO: 76718 - RNA, 75 nt, Artificial Sequence
  B7Z8K6
cugggccucagaaugcuuuucgccaagaccguggcugucaacuuucuguugacagcaaaauuauucuuucuguga

SEQ ID NO: 76719 - RNA, 627 nt, Artificial Sequence
  B9A064
accaucauuggcgugagcguccuguccguucucgugguaucuguggucgccgugcuuguuuacaaguucuauuuucaccugauguuguuagcugggugcauaaaauacggaagaggugagaacaucuaugacgcauucgugauuuacucaagucaggaugaagacugggucaggaaugagcuggugaagaaccuagaagagggcguacccccuuuucaacucugucugcauuaucgggauuucaucccagggguugccauugcggcuaauaucauacacgaaggauuucauaaaagccgcaaggugaucgucguggugucccagcacuucauucagucucgauggugcaucuuugaguacgagauugcccagacauggcaauuccuuucgucacgugcaggcaucauauuuauuguccugcagaaaguugaaaagacuuugcucagacaacagguggagcuguauaggcugcucagccggaacacguacuuagaaugggaggacaguguacugggucgccauaucuucuggagaaggcuucggaaggccuugcuggaugggaaauccuggaauccggagggaaccgugggcacaggcuguaacuggcaggaagcuacuucuauuuga

SEQ ID NO: 76720 - RNA, 189 nt, Artificial Sequence
  O00206
auggcccugaucgugcucggcggggucgcuggacuucuguuguucauugguuuaggcauauuuuucugcguuagauguaggcaccggcgccgacaggcagaacguaugagccaaaucaagagacugcuauccgagaaaaagaccugccaguguccccauagguuucagaaaacaugcucuccuauuuga

SEQ ID NO: 76721 - RNA, 84 nt, Artificial Sequence
  P01730
auccugcucggcaaggccacccuuuacgcugugcuggucagcgcauugguuuuaauggccauggugaaaagaaaggacuucuga

SEQ ID NO: 76722 - RNA, 246 nt, Artificial Sequence
  P01850
gugaugagcgucgccaccaucguuauuguggacauaugcaucacaggcgggcugcuccuucugguauacuauugguccaagaacagaaaagcuaaggcaaaacccgugacuaggggagccggugcgggcgggcggcagcgcggacaaaauaaggagcgaccuccaccgguccccaacccugauuacgaaccaauucguaaaggccagagagacuuguauucugguuuaaaucagaggcggaucuga

SEQ ID NO: 76723 - RNA, 2190 nt, Artificial Sequence
  P07766
gcccugaucgcuuuccucgcauuucuuauuauagugaccagcaucgcccuguuggucguuuuauacaagauuuaugaccugcacaaaaagagauccugcaaccuagaugagcagcaagaacucguggagagggacgaugaaaaacagcugaugaauguagagcccauccaugcggacauucuucuggaaacauacaagcggaaaaucgcugaugagggccgcuuguuccucgccgaguuucagucuauaccucgaguguucucaaaguuuccaaucaaggaagcacguaaaccguucaaccagaauaagaacagauaugucgacauucugcccuacgauuauaauaggguggagcugagugaaaucaacggggacgccggaagcaauuacauuaacgcuuccuauaucgaugguuuuaaagagccucggaaguacauagcagcccaaggcccacgcgacgagacuguugaugacuucuggagaaugauuugggaacagaaagcuacggugaucgucauggugaccaggugugaggaagggaaucggaacaagugcgccgaguacuggcccucuauggaagagggaacacgcgcguuuggcgauguaguugugaagauuaaucagcacaaacgauguccugacuauaucauccagaagcucaacauugucaauaaaaaggagaaagcaacugguagagaagugacccauauacaauucacaucguggccagaccacggggugcccgaggauccucauuuacugcuuaaguugaggcggcgugucaacgccuuuucaaauuucuuuagcggaccaaucguugugcacugcagugcuggcguaggccgcaccgggacuuacauuggaaucgacgccaugcuggaaggucuagaggcagaaaacaaaguggaugucuauggcuacgugguuaagcucagaaggcagcggugucugauggugcaggucgaggcucaguauauacuuauucaccaagcccugguggaguacaaccaguucggggaaacagagguaaauuuguccgaacuccauccguaucugcacaacaugaagaaacgagaucccccuucugagccaagccccuuagaagcggaguuccagcgccugccuuccuacagaucauggaggacccaacauaucggaaaucaggaggaaaacaagaguaaaaaucggaacagcaauguuaucccauacgacuauaaccgcgugccccucaagcacgagcuugaaaugucuaaagaguccgagcacgacucagaugaaagcagugacgaugacucugauuccgaggaaccgagcaaguacauuaaugccucguuuaucaugucuuauuggaagccugaggucaugauugcagcucagggcccccugaaagaaacgauaggugacuucuggcagaugaucuuucaaagaaaggugaaagucauugugauguugacugagcuaaagcauggggaccaggagaucugcgcccaguacuggggagaaggcaaacagaccuauggcgauaucgagguugaccugaaggauacagacaaguccucaacuuacacccucaggguguucgaacugcgucacaguaaacggaaggauagccgaacaguauaucaauaccaguacaccaacugguccgucgagcagcuuccagcugaaccuaaagagcugauuucuaugauacaggugguuaagcaaaaauugccccagaagaauagcucagaggggaacaagcaucacaaaaguacgccacuccugauccauuguagagacggaucccagcagacugguaucuuuugcgccuuacugaaucuacucgaaagcgcagagacagaagagguggucgauauuuuccaagugguaaaggcccugaggaaagcucgccccggcauggugucuaccuuugaacaguaucaguuccuuuacgacguuauugcgucaacuuauccugcacaaaacgggcaggucaagaaaaauaaccaccaggaggauaagaucgaguuugacaacgaaguggauaaagugaagcaggacgccaauugugucaacccauugggagcuccggagaagcugcccgaagccaaagagcaagcagagggcagugaaccuacaagcgguaccgaggggccagaacacuccguuaauggccccgccucuccugcucucaaccagggaucguga

SEQ ID NO: 76724 - RNA, 141 nt, Artificial Sequence
  P08575
gugagcuucugccuggucaugguucuccuuuuugccguggacaccggccuguacuucuccguaaagacaaacaucagaucuucaacuagggauuggaaagaccacaaguuuaaauggcggaaggauccccaggacaaauga

SEQ ID NO: 76725 - RNA, 207 nt, Artificial Sequence
  P08637
uucugggugcuggucguugugggcgggguacucgccugcuacagccuucuggugaccgucgcuuuuaucauuuucugggugagauccaagaggucucgguuguuacacucagacuauaugaacaugacaccccgccgaccuggaccaacucguaaacauuaccagccguaugcacccccuagagauuuugccgcguacaggaguuga

SEQ ID NO: 76726 - RNA, 252 nt, Artificial Sequence
  P10747
aucauuaccgcagagggcauaauccuccuguucugcgcugugguccccgggacacuucuguuguuuagaaagagguggcagaacgaaaaauuaggacuggacgccggugaugaguacgaagacgagaaucuauaugaaggccucaaccuggaugacuguagcauguacgaggauauuucccgggggcuucaaggaacuuaucaggacguuggcucucugaauaucggugaugugcaguuggagaagccuuga

SEQ ID NO: 76727 - RNA, 798 nt, Artificial Sequence
  P11912
gugagcgccgucacccuggcuuaccucaucuucugccuuuguucccugguuggcauuuugcacuuacagagagcacuggugcuaaggcggaagcgcaaacgaaugacagaccccacucguagauuuuucaagguaacgccuccaccggggucuggaccccaaaaccaguaugguaaugugcucucacugccuaccccaacaaguggccuugggagggcccagcggugggcggcuggacugggcgguacugcccccagcuacgggaacccuuccucugauguccaggcagacggagccuugggcucgcgcucaccacccggcguggggccugaggaagaggaaggagaggguuaugaggaaccagauagcgaggaagacagugaguuuuacgaaaaugauuccaaccucggccaagaccagcugucucaggaugggagcggauaugagaauccggaggacgaaccccugggcccugaggaugaagacuccuucucaaacgcugagaguuacgaaaaugaggaugaggaacucacccagccaguugcaagaacaauggacuuuuuaagcccccaugguucugccugggauccuuccagggaggcuaccucacuggggagccaaaguuaugaagacaugcggggaauacuuuacgccgcgccacaguugcgcucuauccgaggccagcccggcccgaaccacgaggaagacgcagauuccuacgagaauauggacaacccugaugggcccgacccagccuggggagguggcgggagaaugggaacuuggagcacaagguga

SEQ ID NO: 76728 - RNA, 189 nt, Artificial Sequence
  P15391
uuccugcucuggauccuugccgcugugagcuccggccuguuuuucuacucuuuucuauuaaccgcagucucacugaguaagauguugaaaaagagaagcccccucacaacugggguuuaugugaaaaugccuccaacggagccggaaugcgagaagcaguuccaacccuacuuuauuccuauaaacuga

SEQ ID NO: 76729 - RNA, 219 nt, Artificial Sequence
  P16410
augggcuggaucagagggaggcggagccgccacuccugggagaugucugaguuccauaacuacaaucuggaccucaagaaaucagauuuuaguacccgauggcagaagcaacguugccccguggucaaaagcaaguguagagaaaacgccuccccuuucuuuuucugcuguuuuauugcuguugcaaugggaauaagguucaucauuaugguggccuga

SEQ ID NO: 76730 - RNA, 192 nt, Artificial Sequence
  P16671
cugugcuacauccucgacgccauucuuuuccuguauggcauaguguugaccuuacuguacuguagacuaaagauccaggucaggaaagcugcaauuacaagcuaugagaaguccgaugggguuuacacuggacucucuacgcggaaccaagaaaccuaugagacacugaaacacgaaaagcccccucaguga

SEQ ID NO: 76731 - RNA, 213 nt, Artificial Sequence
  P26718
ggcaucauuaugauacagacccugcucaucauucuuuucaucauugugcccaucuuucuguuguuagacaaggaugacagcaaagccgggauggaggaagaucacacauacgagggacuggacauagaucaaacugcuacguaugaagacaucgucacccuaagaacaggugagguuaagugguccgugggcgaacauccugggcaggaguga

SEQ ID NO: 76732 - RNA, 249 nt, Artificial Sequence
  P30273
uggaucaccgccgugcugcccacagucauuauaugcguuaugguguucugucucauccuuuggaaguggaaaaagaaaaagagaccuaggaacagcuacaaaugcggcacuaauacgauggagcgggaagaguccgaacagaccaagaagcgcgagaaaauucacaucccagaacgaucugacgaggcucaacguguauuuaagucaaguaaaacaagcuccugugauaagucugacacuugcuucuga

SEQ ID NO: 76733 - RNA, 249 nt, Artificial Sequence
  P32248
ggcgggaccgugcugcuccuucuguucgucaucagcauuacaacuauaaucguuaucuuuuugaacagaaggcggcgccgagagcguagagacuuauucacggaauccugggauacccagaaggcccccaauaacuacaggucuccuauuucaacaagucaaccaacuaaucagagcauggacgauacccgggaggacauuuaugugaacuacccgacauuuucccgcagacccaaaaccaggguauga

SEQ ID NO: 76734 - RNA, 303 nt, Artificial Sequence
  P40259
cuggugggcgccggggucguucucaugcuuaucauucugguggcuuuguuaaugcugguauucagaagcaagagggaggugaaacggcagaaguaccgccuaucccaacucuauaaauggcaggaagaggacucuggacccgcaccugguaccuuucagaacauaggcuucgauaucugccaggacgaugacucaauucaccuggaaaguaucuacagcaauuuucaaccaucccuucgacauauugauccggagacaaagauccguauacagagaccccaggucaugacuacgucuuucuga

SEQ ID NO: 76735 - RNA, 177 nt, Artificial Sequence
  P42081
augagcgacuccaaggagcccagacugcagcaacucggccuucuggaagaggaacaguugaggggguuaggauuccggcagacccgcgguuacaaaucucuggccggcugccuagggcacggaccucucgugcugcagcuucugucauuuacauugcucgcuggccugcuggucuga

SEQ ID NO: 76736 - RNA, 645 nt, Artificial Sequence
  Q15762
gccgugauccuguucuuuuucaccuuuuucauuacaacuauggucaugcucgcugcacuugcccaccaucuguuuuacugggacguuugguucauauauaacgugugcuuggcgaagguaaaaggcuaccgcagcuuauccacgucucagaccuuuuaugaugcuuacaucucauaugacacaaaggaugccagugugacugacugggucauuaaugagcugagguaccaccuagaagagagccgggauaaaaacgugcuccugugucuugaagagagagacugggaucccgggcuggcaaucauugacaauuugaugcaauccaucaaccagucuaagaaaaccguuuucgugcucacaaagaaguaugccaaaucguggaauuuuaagaccgcuuucuaccuggcacugcagcgacucauggaugaaaacauggacgucauaaucuuuauuuuacuggagccugugcuucagcauucacaauacuugcgucugagacagaggaucugcaaaagcaguauucuacaguggccagauaauccgaaggccgagggacucuucuggcagacucugcggaacguaguucuuacagaaaaugacucccgcuauaacaauauguacguggauucuaucaaacaauauuga

SEQ ID NO: 76737 - RNA, 102 nt, Artificial Sequence
  Q685J3
cugcucggccuuaucgagaugauucuguugagcgugggggucguuauguucguggccuuuaugauauccuacugcgcuuguagaucuaagaccaucaaauga

SEQ ID NO: 76738 - RNA, 120 nt, Artificial Sequence
  Q9NNX6
gacagauacguggccaucguccaggcuguuagcgcacacaggcaucgggcccgcgugcugcucauuuccaagcugucuugcguaggcauauggauccuugcgaccguguugucaauuuga

SEQ ID NO: 76739 - RNA, 129 nt, Artificial Sequence
  Q9NR97
agaacccugcuccaggccaggaacuucgagcggaauaaggcuaucaaagugauuauagcagucguugugguauuuaucguguuccaacuucccuacaacggcgucgugcuggcccagacaguugcguga

SEQ ID NO: 76740 - RNA, 105 nt, Artificial Sequence
  A0A5B9
accauccuguacgagauccugcugggcaaggccacccuguacgccgugcuggugagcgcccuggugcugauggccauggugaagagaaaggacagcagaggcuga

SEQ ID NO: 76741 - RNA, 75 nt, Artificial Sequence
  B7Z8K6
cugggccugagaaugcuguucgccaagaccguggccgugaacuuccugcugaccgccaagcuguucuuccuguga

SEQ ID NO: 76742 - RNA, 627 nt, Artificial Sequence
  B9A064
accaucaucggcgugagcgugcugagcgugcugguggugagcgugguggccgugcugguguacaaguucuacuuccaccugaugcugcuggccggcugcaucaaguacggcagaggcgagaacaucuacgacgccuucgugaucuacagcagccaggacgaggacugggugagaaacgagcuggugaagaaccuggaggagggcgugccccccuuccagcugugccugcacuacagagacuucauccccggcguggccaucgccgccaacaucauccacgagggcuuccacaagagcagaaaggugaucgugguggugagccagcacuucauccagagcagauggugcaucuucgaguacgagaucgcccagaccuggcaguuccugagcagcagagccggcaucaucuucaucgugcugcagaagguggagaagacccugcugagacagcagguggagcuguacagacugcugagcagaaacaccuaccuggagugggaggacagcgugcugggcagacacaucuucuggagaagacugagaaaggcccugcuggacggcaagagcuggaaccccgagggcaccgugggcaccggcugcaacuggcaggaggccaccagcaucuga

SEQ ID NO: 76743 - RNA, 189 nt, Artificial Sequence
  O00206
auggcccugaucgugcugggcggcguggccggccugcugcuguucaucggccugggcaucuucuucugcgugagaugcagacacagaagaagacaggccgagagaaugagccagaucaagagacugcugagcgagaagaagaccugccagugcccccacagauuccagaagaccugcagccccaucuga

SEQ ID NO: 76744 - RNA, 84 nt, Artificial Sequence
  P01730
auccugcugggcaaggccacccuguacgccgugcuggugagcgcccuggugcugauggccauggugaagagaaaggacuucuga

SEQ ID NO: 76745 - RNA, 246 nt, Artificial Sequence
  P01850
gugaugagcguggccaccaucgugaucguggacaucugcaucaccggcggccugcugcugcugguguacuacuggagcaagaacagaaaggccaaggccaagcccgugaccagaggcgccggcgccggcggcagacagagaggccagaacaaggagagacccccccccgugcccaaccccgacuacgagcccaucagaaagggccagagagaccuguacagcggccugaaccagagaagaaucuga

SEQ ID NO: 76746 - RNA, 2190 nt, Artificial Sequence
  P07766
gcccugaucgccuuccuggccuuccugaucaucgugaccagcaucgcccugcugguggugcuguacaagaucuacgaccugcacaagaagagaagcugcaaccuggacgagcagcaggagcugguggagagagacgacgagaagcagcugaugaacguggagcccauccacgccgacauccugcuggagaccuacaagagaaagaucgccgacgagggcagacuguuccuggccgaguuccagagcauccccagaguguucagcaaguuccccaucaaggaggccagaaagcccuucaaccagaacaagaacagauacguggacauccugcccuacgacuacaacagaguggagcugagcgagaucaacggcgacgccggcagcaacuacaucaacgccagcuacaucgacggcuucaaggagcccagaaaguacaucgccgcccagggccccagagacgagaccguggacgacuucuggagaaugaucugggagcagaaggccaccgugaucgugauggugaccagaugcgaggagggcaacagaaacaagugcgccgaguacuggcccagcauggaggagggcaccagagccuucggcgacgugguggugaagaucaaccagcacaagagaugccccgacuacaucauccagaagcugaacaucgugaacaagaaggagaaggccaccggcagagaggugacccacauccaguucaccagcuggcccgaccacggcgugcccgaggacccccaccugcugcugaagcugagaagaagagugaacgccuucagcaacuucuucagcggccccaucguggugcacugcagcgccggcgugggcagaaccggcaccuacaucggcaucgacgccaugcuggagggccuggaggccgagaacaagguggacguguacggcuacguggugaagcugagaagacagagaugccugauggugcagguggaggcccaguacauccugauccaccaggcccugguggaguacaaccaguucggcgagaccgaggugaaccugagcgagcugcaccccuaccugcacaacaugaagaagagagacccccccagcgagcccagcccccuggaggccgaguuccagagacugcccagcuacagaagcuggagaacccagcacaucggcaaccaggaggagaacaagagcaagaacagaaacagcaacgugauccccuacgacuacaacagagugccccugaagcacgagcuggagaugagcaaggagagcgagcacgacagcgacgagagcagcgacgacgacagcgacagcgaggagcccagcaaguacaucaacgccagcuucaucaugagcuacuggaagcccgaggugaugaucgccgcccagggcccccugaaggagaccaucggcgacuucuggcagaugaucuuccagagaaaggugaaggugaucgugaugcugaccgagcugaagcacggcgaccaggagaucugcgcccaguacuggggcgagggcaagcagaccuacggcgacaucgagguggaccugaaggacaccgacaagagcagcaccuacacccugagaguguucgagcugagacacagcaagagaaaggacagcagaaccguguaccaguaccaguacaccaacuggagcguggagcagcugcccgccgagcccaaggagcugaucagcaugauccagguggugaagcagaagcugccccagaagaacagcagcgagggcaacaagcaccacaagagcaccccccugcugauccacugcagagacggcagccagcagaccggcaucuucugcgcccugcugaaccugcuggagagcgccgagaccgaggaggugguggacaucuuccagguggugaaggcccugagaaaggccagacccggcauggugagcaccuucgagcaguaccaguuccuguacgacgugaucgccagcaccuaccccgcccagaacggccaggugaagaagaacaaccaccaggaggacaagaucgaguucgacaacgagguggacaaggugaagcaggacgccaacugcgugaacccccugggcgcccccgagaagcugcccgaggccaaggagcaggccgagggcagcgagcccaccagcggcaccgagggccccgagcacagcgugaacggccccgccagccccgcccugaaccagggcagcuga

SEQ ID NO: 76747 - RNA, 141 nt, Artificial Sequence
  P08575
gugagcuucugccuggugauggugcugcuguucgccguggacaccggccuguacuucagcgugaagaccaacaucagaagcagcaccagagacuggaaggaccacaaguucaaguggagaaaggacccccaggacaaguga

SEQ ID NO: 76748 - RNA, 207 nt, Artificial Sequence
  P08637
uucugggugcuggugguggugggcggcgugcuggccugcuacagccugcuggugaccguggccuucaucaucuucugggugagaagcaagagaagcagacugcugcacagcgacuacaugaacaugacccccagaagacccggccccaccagaaagcacuaccagcccuacgccccccccagagacuucgccgccuacagaagcuga

SEQ ID NO: 76749 - RNA, 252 nt, Artificial Sequence
  P10747
aucaucaccgccgagggcaucauccugcuguucugcgccguggugcccggcacccugcugcuguucagaaagagauggcagaacgagaagcugggccuggacgccggcgacgaguacgaggacgagaaccuguacgagggccugaaccuggacgacugcagcauguacgaggacaucagcagaggccugcagggcaccuaccaggacgugggcagccugaacaucggcgacgugcagcuggagaagcccuga

SEQ ID NO: 76750 - RNA, 798 nt, Artificial Sequence
  P11912
gugagcgccgugacccuggccuaccugaucuucugccugugcagccuggugggcauccugcaccugcagagagcccuggugcugagaagaaagagaaagagaaugaccgaccccaccagaagauucuucaaggugacccccccccccggcagcggcccccagaaccaguacggcaacgugcugagccugcccacccccaccagcggccugggcagagcccagagaugggccgccggccugggcggcaccgcccccagcuacggcaaccccagcagcgacgugcaggccgacggcgcccugggcagcagaagcccccccggcgugggccccgaggaggaggagggcgagggcuacgaggagcccgacagcgaggaggacagcgaguucuacgagaacgacagcaaccugggccaggaccagcugagccaggacggcagcggcuacgagaaccccgaggacgagccccugggccccgaggacgaggacagcuucagcaacgccgagagcuacgagaacgaggacgaggagcugacccagcccguggccagaaccauggacuuccugagcccccacggcagcgccugggaccccagcagagaggccaccagccugggcagccagagcuacgaggacaugagaggcauccuguacgccgccccccagcugagaagcaucagaggccagcccggccccaaccacgaggaggacgccgacagcuacgagaacauggacaaccccgacggccccgaccccgccuggggcggcggcggcagaaugggcaccuggagcaccagauga

SEQ ID NO: 76751 - RNA, 189 nt, Artificial Sequence
  P15391
uuccugcuguggauccuggccgccgugagcagcggccuguucuucuacagcuuccugcugaccgccgugagccugagcaagaugcugaagaagagaagcccccugaccaccggcguguacgugaagaugccccccaccgagcccgagugcgagaagcaguuccagcccuacuucauccccaucaacuga

SEQ ID NO: 76752 - RNA, 219 nt, Artificial Sequence
  P16410
augggcuggaucagaggcagaagaagcagacacagcugggagaugagcgaguuccacaacuacaaccuggaccugaagaagagcgacuucagcaccagauggcagaagcagagaugccccguggugaagagcaagugcagagagaacgccagccccuucuucuucugcugcuucaucgccguggccaugggcaucagauucaucaucaugguggccuga

SEQ ID NO: 76753 - RNA, 192 nt, Artificial Sequence
  P16671
cugugcuacauccuggacgccauccuguuccuguacggcaucgugcugacccugcuguacugcagacugaagauccaggugagaaaggccgccaucaccagcuacgagaagagcgacggcguguacaccggccugagcaccagaaaccaggagaccuacgagacccugaagcacgagaagcccccccaguga

SEQ ID NO: 76754 - RNA, 213 nt, Artificial Sequence
  P26718
ggcaucaucaugauccagacccugcugaucauccuguucaucaucgugcccaucuuccugcugcuggacaaggacgacagcaaggccggcauggaggaggaccacaccuacgagggccuggacaucgaccagaccgccaccuacgaggacaucgugacccugagaaccggcgaggugaaguggagcgugggcgagcaccccggccaggaguga

SEQ ID NO: 76755 - RNA, 249 nt, Artificial Sequence
  P30273
uggaucaccgccgugcugcccaccgugaucaucugcgugaugguguucugccugauccuguggaaguggaagaagaagaagagacccagaaacagcuacaagugcggcaccaacaccauggagagagaggagagcgagcagaccaagaagagagagaagauccacauccccgagagaagcgacgaggcccagagaguguucaagagcagcaagaccagcagcugcgacaagagcgacaccugcuucuga

SEQ ID NO: 76756 - RNA, 249 nt, Artificial Sequence
  P32248
ggcggcaccgugcugcugcugcuguucgugaucagcaucaccaccaucaucgugaucuuccugaacagaagaagaagaagagagagaagagaccuguucaccgagagcugggacacccagaaggcccccaacaacuacagaagccccaucagcaccagccagcccaccaaccagagcauggacgacaccagagaggacaucuacgugaacuaccccaccuucagcagaagacccaagaccagaguguga

SEQ ID NO: 76757 - RNA, 303 nt, Artificial Sequence
  P40259
cuggugggcgccggcguggugcugaugcugaucauccugguggcccugcugaugcugguguucagaagcaagagagaggugaagagacagaaguacagacugagccagcuguacaaguggcaggaggaggacagcggccccgcccccggcaccuuccagaacaucggcuucgacaucugccaggacgacgacagcauccaccuggagagcaucuacagcaacuuccagcccagccugagacacaucgaccccgagaccaagaucagaauccagagaccccaggugaugaccaccagcuucuga

SEQ ID NO: 76758 - RNA, 177 nt, Artificial Sequence
  P42081
augagcgacagcaaggagcccagacugcagcagcugggccugcuggaggaggagcagcugagaggccugggcuucagacagaccagaggcuacaagagccuggccggcugccugggccacggcccccuggugcugcagcugcugagcuucacccugcuggccggccugcugguguga

SEQ ID NO: 76759 - RNA, 645 nt, Artificial Sequence
  Q15762
gccgugauccuguucuucuucaccuucuucaucaccaccauggugaugcuggccgcccuggcccaccaccuguucuacugggacgugugguucaucuacaacgugugccuggccaaggugaagggcuacagaagccugagcaccagccagaccuucuacgacgccuacaucagcuacgacaccaaggacgccagcgugaccgacugggugaucaacgagcugagauaccaccuggaggagagcagagacaagaacgugcugcugugccuggaggagagagacugggaccccggccuggccaucaucgacaaccugaugcagagcaucaaccagagcaagaagaccguguucgugcugaccaagaaguacgccaagagcuggaacuucaagaccgccuucuaccuggcccugcagagacugauggacgagaacauggacgugaucaucuucauccugcuggagcccgugcugcagcacagccaguaccugagacugagacagagaaucugcaagagcagcauccugcaguggcccgacaaccccaaggccgagggccuguucuggcagacccugagaaacguggugcugaccgagaacgacagcagauacaacaacauguacguggacagcaucaagcaguacuga

SEQ ID NO: 76760 - RNA, 102 nt, Artificial Sequence
  Q685J3
cugcugggccugaucgagaugauccugcugagcgugggcguggugauguucguggccuucaugaucagcuacugcgccugcagaagcaagaccaucaaguga

SEQ ID NO: 76761 - RNA, 120 nt, Artificial Sequence
  Q9NNX6
gacagauacguggccaucgugcaggccgugagcgcccacagacacagagccagagugcugcugaucagcaagcugagcugcgugggcaucuggauccuggccaccgugcugagcaucuga

SEQ ID NO: 76762 - RNA, 129 nt, Artificial Sequence
  Q9NR97
agaacccugcugcaggccagaaacuucgagagaaacaaggccaucaaggugaucaucgccgugguggugguguucaucguguuccagcugcccuacaacggcguggugcuggcccagaccguggccuga

SEQ ID NO: 76763 - RNA, 105 nt, Artificial Sequence
  A0A5B9
accauccuguacgagauucuccugggcaaggccacacuuuaugcugugcuggucagcgcccucguucugauggcgauggugaaaagaaaggacucccggggguga

SEQ ID NO: 76764 - RNA, 75 nt, Artificial Sequence
  B7Z8K6
cugggccucagaaugcuguucgccaagaccguggcugucaacuuucuucugacagccaaacucuucuuucuguga

SEQ ID NO: 76765 - RNA, 627 nt, Artificial Sequence
  B9A064
accaucauuggcgugagcguccuguccguucucguggugucugucguggccguucugguguacaaguucuauuuucaccuuaugcugcucgcugggugcaucaaauacggaagaggcgagaacauuuaugacgccuucgucaucuacagcucccaggaugaagacugggugcggaaugagcugguuaagaaccuugaagagggggugcccccuuuucaacugugucuccauuaucgcgauuucauuccgggagucgcgaucgcugccaauaucauucacgaaggcuuucauaaaucuagaaaggugaucguggucguuagccagcacuucauucagucccgguggugcaucuuugaguacgagauugcccagacauggcaauuccugucuagccgcgcugggaucauuuuuaucgugcugcagaaaguggaaaagacgcuccugagacagcaggucgagcuuuaucggcugcucucccgcaacaccuaccuggaaugggaggacagcgugcuuggaagacauaucuucuggcggcgccugagaaaggcccuccuggauggcaaaucuuggaaucccgagggcacaguugggaccggauguaacuggcaagaagcuacauccauuuga

SEQ ID NO: 76766 - RNA, 189 nt, Artificial Sequence
  O00206
auggcccugaucgugcucggcggggucgcuggacugcuucuguucauuggccucgggaucuuuuucugcguuagaugucggcaccgcagacggcaggccgaacgcaugagccaaauuaagagacugcuuuccgagaaaaagaccugccaguguccccaucgguuucagaaaacaugcucuccuaucuga

SEQ ID NO: 76767 - RNA, 84 nt, Artificial Sequence
  P01730
auccugcucggcaaggccacccuguacgcugugcuugucagcgcccugguucucauggcgauggugaaaagaaaggacuucuga

SEQ ID NO: 76768 - RNA, 246 nt, Artificial Sequence
  P01850
gugaugagcgucgccaccaucguuauuguggacaucugcauuacaggcgggcugcuccugcuuguguacuauugguccaagaacagaaaagcuaaggccaaacccgucacgcggggagcgggcgcugggggacgccagagaggccaaaauaaggagcggccuccgcccgugccuaaccccgauuacgaaccuauccgcaaagggcagagagaccuguauucuggacucaaucagcggcgcauuuga

SEQ ID NO: 76769 - RNA, 2190 nt, Artificial Sequence
  P07766
gcccugaucgcuuuccucgccuuucugauuaucgugaccagcauugcgcuucuggucguucucuacaagaucuaugaccugcacaaaaagagauccugcaaccuugaugagcagcaagaacugguggagcgggacgaugaaaaacagcucaugaauguggagcccauucaugcugacauccugcuggaaacauacaagcgcaaaaucgccgaugagggcagacucuuccuggccgaguuucagucuauuccucgggucuucagcaaguuuccgaucaaggaagcucgcaaacccuucaaccagaauaagaacagauauguggacauucuuccuuacgauuauaaucggguugagcuguccgaaaucaacggggacgccggaucuaauuacauuaacgcuagcuauaucgauggcuuuaaagagccccgcaaguacauugccgcgcaagggccuagagacgagacgguggaugacuucuggcggaugaucugggaacagaaagccaccgucaucgugaugguuacacgcugugaggaaggaaauagaaacaagugcgcugaguacuggcccuccauggaagagggcacccgggccuuuggggauguggucgugaagauuaaucagcacaaacgcuguccugacuauaucauucagaagcucaacaucgugaauaaaaaggagaaagcuacaggaagagaagucacccauauucaauucacaucuuggccggaccacggcguucccgaggauccucaucugcuucugaagcuccggcgcagagugaacgccuuuagcaauuucuuuuccggccccaucgugguccacugcagcgcgggggugggacggaccggcacguacaucgggauugacgccaugcuggaaggacuggaggcugaaaacaaaguugauguguauggcuacgucgugaagcucagacgccagcggugucugaugguucagguggaggcccaguauauccuuauucaccaagcucuggucgaguacaaccaguucggggaaaccgaggugaaucucucugaacugcauccuuaucuucacaacaugaagaaaagagaucccccguccgagccuagcccccuggaagccgaguuccagcgccucccuucuuaccgguccuggagaacacaacauaucggaaaucaggaggaaaacaagagcaaaaaucgcaacucuaaugucauucccuacgacuauaaccgggugccccugaagcacgagcuggaaauguccaaagagagcgagcacgacuccgaugaaucuagcgacgaugacuccgauagcgaggaaccuucuaaguacaucaaugccuccuuuaucaugagcuauuggaagccggagguuaugauugcugcgcagggcccccucaaagaaaccaucggcgacuucuggcagaugauuuuucaaagaaaggugaaagucaucgugaugcugacagagcuuaagcauggggaccaggagauuugcgcccaguacuggggagaaggcaaacagaccuauggggauaucgagguugaccugaaggauacggacaagucuagcacauacacccuccgcguguucgaacugcggcacuccaaaagaaaggauucucgcacagucuaucaauaccaguacaccaacuggagcguggagcagcuuccugcugaacccaaagagcugauuuccaugauccaggugguuaagcaaaaacucccucagaagaauagcucugagggaaacaagcaucacaaauccacaccccugcugauccauugucgggacggcagccagcagaccgggaucuuuugcgcccuccugaaucuucuggaaucugccgagacggaagaggucguggauauuuuccaaguggucaaggcucucagaaaagcccggccgggaaugguguccaccuuugaacaguaucaguuccuguacgacguuauugcgagcacauauccugcucaaaacggccaggugaagaaaaauaaccaccaggaggauaagaucgaguuugacaacgaagucgauaaagugaagcaggacgccaauuguguuaacccccugggcgccccugagaaacuucccgaagcuaaggagcaagccgagggguccgaaccuaccucuggaacagagggccccgaacacagcgugaaugggccggcuuccccugcccucaaccagggaucuuga

SEQ ID NO: 76770 - RNA, 141 nt, Artificial Sequence
  P08575
gugagcuucugccuggucaugguucuccuguuugccguggacaccggccuuuacuucuccgugaagacaaacaucagaucuagcacgcgggauuggaaagaccacaaguuuaaauggcgcaaggauccccaggacaaauga

SEQ ID NO: 76771 - RNA, 207 nt, Artificial Sequence
  P08637
uucugggugcuggucguugugggcggggugcucgccugcuacagccugcuugucaccguggcuuuuaucauuuucuggguuagauccaagcggucucgccugcuccacagcgacuauaugaacaugacacccagacggccuggaccgacgcgcaaacauuaccagcccuaugccccucccagagauuuugcggcuuaccgguccuga

SEQ ID NO: 76772 - RNA, 252 nt, Artificial Sequence
  P10747
aucauuaccgccgagggcaucauucuccuguucugcgcugugguccccgggacacugcuucuguuuagaaagcgguggcagaacgaaaaacucggacuggacgccggcgaugaguacgaagacgagaaucuuuaugaagggcugaaccucgaugacuguagcauguacgaggauaucucccgcggacugcaaggcacguaucaggacguugggucucugaauauuggagaugugcagcucgagaagccuuga

SEQ ID NO: 76773 - RNA, 798 nt, Artificial Sequence
  P11912
gugagcgccgucacccuggcuuaccucaucuucugccuguguucccuuguuggcauucugcaccuccagagagcccuggugcuucggcgcaagagaaaacggaugacagaccccacgcgcagauuuuucaaggugaccccuccgcccgggucuggaccucaaaaccaguauggcaauguccugagccuccccacaccuaccuccgggcugggacgggcgcagcgcugggcugccggccucgggggaacagcccccucuuacggcaacccuagcuccgaugugcaggcugacggcgcccuggggucuagaagcccgcccggaguuggcccugaggaagaggaaggggagggauaugaggaacccgauuccgaggaagacagcgaguuuuacgaaaaugauucuaaccugggccaagaccagcuuucccaggaugggagcggauaugagaauccugaggacgaaccccugggcccggaggaugaagacucuuucuccaacgcugagagcuacgaaaaugaggaugaggaacucacccagccuguggcccggacaauggacuuucugucuccccauggcuccgcgugggauccuagccgcgaggccaccucccuugggucucaaagcuaugaagacaugagaggaauccuguacgcugcuccccagcuccgguccauucgcggccagcccgggccuaaccacgaggaagacgccgauagcuacgagaauauggacaacccggauggacccgacccugccuggggcgggggaggcagaaugggcacguggucuacccgguga

SEQ ID NO: 76774 - RNA, 189 nt, Artificial Sequence
  P15391
uuccugcucuggauccuggccgcugugagcuccggccuguuuuucuacucuuuucuucucaccgccgucagccuguccaagaugcuuaaaaagagaucuccccugacaacggggguuuaugugaaaaugccuccgaccgagcccgaaugcgagaagcaguuccaaccuuacuuuauucccaucaacuga

SEQ ID NO: 76775 - RNA, 219 nt, Artificial Sequence
  P16410
augggcuggaucagagggcggcgcagcagacacuccugggagaugucugaguuccauaacuacaaucuggaccucaagaaaagcgauuuuuccacccgguggcagaagcaacgcugccccguggucaaaucuaaguguagagaaaacgccagcccuuucuuuuucugcuguuuuauugcuguugccaugggaauccgguucauuaucaugguggcguga

SEQ ID NO: 76776 - RNA, 192 nt, Artificial Sequence
  P16671
cugugcuacauccucgacgccauucuguuccuuuauggcaucgugcugacccuccuguacuguagacuuaagauucagguccggaaagcugccaucacaagcuaugagaaguccgaugggguuuacacgggacugucuacccgcaaccaagaaacauaugagacccucaaacacgaaaagcccccucaguga

SEQ ID NO: 76777 - RNA, 213 nt, Artificial Sequence
  P26718
ggcaucauuaugauccagacccugcucauuauccuguucauuaucgugcccaucuuucuucugcucgacaaggaugacagcaaagccgggauggaggaagaucacacauacgagggacuggacauugaucaaacggcuaccuaugaagacaucgucacacuuagaaccggcgagguuaagugguccgugggggaacauccuggacaggaguga

SEQ ID NO: 76778 - RNA, 249 nt, Artificial Sequence
  P30273
uggaucaccgccgugcugcccacagucauuaucugcguuaugguguucugucucauucuguggaaguggaaaaagaaaaagagaccucggaacagcuacaaaugcggcacgaauaccauggagcgcgaagaguccgaacagacaaagaagagagagaaaauccacauuccggaacggucugacgaggcucaacgcguguuuaagagcuccaaaaccucuagcugugauaaguccgacacaugcuucuga

SEQ ID NO: 76779 - RNA, 249 nt, Artificial Sequence
  P32248
ggcgggaccgugcugcuccugcuuuucgucaucagcauuacaacgaucauuguuaucuuucugaacagacggcgcagacgggagcgcagagaccucuucaccgaauccugggauacacagaaggcccccaauaacuaccggucuccuauuagcaccucccaaccgacaaaucagucuauggacgauacccgcgaggacaucuaugugaacuaccccacauuuagcagacggccuaaaacccgcguguga

SEQ ID NO: 76780 - RNA, 303 nt, Artificial Sequence
  P40259
cuggugggcgccggggucguucucaugcugaucauucuuguggcucugcucaugcugguguucagaagcaagcgggaggucaaacgccagaaguacagacuuucccaacuguauaaauggcaggaagaggacucuggacccgccccuggcaccuuucagaacaucggguucgauauuugccaggacgaugacagcauccaccucgaauccauuuacucuaauuuucaaccgagccugcggcauaucgaucccgagacaaagauccgcauucagagaccucaggugaugacgaccuccuucuga

SEQ ID NO: 76781 - RNA, 177 nt, Artificial Sequence
  P42081
augagcgacuccaaggagcccagacugcagcaacucggccugcuugaagaggaacagcugcgggggcucggauuccgccagaccagaggcuacaaaucucuggccgggugccuuggacacggcccucuggugcuccagcugcugagcuuuacacuccuggcugggcuucuggucuga

SEQ ID NO: 76782 - RNA, 645 nt, Artificial Sequence
  Q15762
gccgugauccuguucuuuuucaccuuuuucauuacaacgauggucaugcucgcugcccuggcgcaccaucuguuuuacugggacguuugguucaucuauaacgugugccuugcuaaggugaaaggcuacagaagccucuccaccucucagacauuuuaugaugccuacauuagcuaugacaccaaggaugccuccgucacagacugggugaucaaugagcugcgguaccaccuugaagagucucgcgauaaaaacguucugcucugucuggaagagagagacugggaucccgggcuggcuauuaucgacaaucucaugcaaagcaucaaccaguccaagaaaaccguguucguccugacaaagaaguaugccaaaucuuggaauuuuaagaccgcuuucuaccuugcccugcagcggcucauggaugaaaacauggacgugauuaucuuuauucugcuugagccuguucugcagcauagccaauaccuccgccugagacagcggaucugcaaauccagcauucugcaguggccggauaaucccaaggcggagggacucuucuggcagacgcugcgcaacgugguccuuaccgaaaaugacucuagauauaacaauauguacguggauuccaucaaacaauauuga

SEQ ID NO: 76783 - RNA, 102 nt, Artificial Sequence
  Q685J3
cugcucggccugaucgagaugauucuucugagcgugggggucguuauguucguggccuuuaugaucuccuacugcgcuuguagaucuaagaccauuaaauga

SEQ ID NO: 76784 - RNA, 120 nt, Artificial Sequence
  Q9NNX6
gacagauacguggccaucguccaggcuguuagcgcccaccggcaucgcgcgagagugcugcucauuuccaagcugucuugcgugggcaucuggauucuugcuaccguccugagcaucuga

SEQ ID NO: 76785 - RNA, 129 nt, Artificial Sequence
  Q9NR97
agaacccugcuccaggcccggaacuucgagcgcaauaaggcuaucaaagugauuaucgccgucguugugguguuuauugucuuccaacugcccuacaacggcgugguucuugcgcagacaguggcuuga

SEQ ID NO: 76786 - RNA, 105 nt, Artificial Sequence
  A0A5B9
acaauacuauacgaaauacuacuaggaaaagcaacacuauaugcaguacuaguaagcgcacuaguacuaauggcaaugguaaaaagaaaagacucaagaggauga

SEQ ID NO: 76787 - RNA, 75 nt, Artificial Sequence
  B7Z8K6
cuuggccuucgcaugcucuuugccaaaacuguugccguuaauuuucucuuaacugcuaaauuauucuuucuuuga

SEQ ID NO: 76788 - RNA, 627 nt, Artificial Sequence
  B9A064
acaauaauaggaguaucaguauuaucaguacuaguaguaaguguaguagcaguacuaguauacaaauucuacuuccacuuaauguuacuagcaggaugcauaaaauauggaagaggagaaaacauauacgacgcauucguaauauacucaucacaagacgaagauuggguaagaaacgaauuaguaaaaaacuuagaagaaggaguaccaccauuccaauuaugucuacauuaccgagacuucauaccaggaguagcaauagcagcaaacauaauacacgaaggauuccacaaaagccgaaaaguaauaguaguaguaucacaacacuucauacaaagcagauggugcauauucgaauacgaaauagcacagacauggcaauuccuaucaucaagagcaggaauaauauucauaguacuacaaaaaguagaaaaaacauuacuaagacaacaaguagaacuauacagguuacuaucaagaaacacauaccuagaaugggaagacucaguacuaggaagacacauauucuggagaagacuaagaaaagcacuauuagacggaaaaucauggaacccagaaggaacaguaggaacaggaugcaacuggcaagaagcaacaucaauauga

SEQ ID NO: 76789 - RNA, 189 nt, Artificial Sequence
  O00206
auggcacuaauaguauuaggaggaguagcaggacuacuauuauucauaggacuaggaauauucuucugcguaagaugcagacacagaagaagacaagcagaaagaaugagccaaauaaaaagacuacuaucagaaaaaaaaacaugccaaugcccacacagauuccaaaaaacaugcucaccaauauga

SEQ ID NO: 76790 - RNA, 84 nt, Artificial Sequence
  P01730
auacuauuaggaaaagcaacacuauaugcaguacuaguaagcgcacuaguacuaauggcaaugguaaaaagaaaagacuuuuga

SEQ ID NO: 76791 - RNA, 246 nt, Artificial Sequence
  P01850
guaaugagcguagcaacaauaguaauaguagacauaugcauaacaggaggacuacuacuacuaguauacuacuggucaaaaaacagaaaagcaaaagcaaaaccaguaacaagaggagcaggagcaggaggaagacaaagaggacaaaacaaagaaagaccaccaccaguaccaaacccagacuacgaaccaauaagaaaaggacaaagagaccuauacucaggacuaaaccaaagaagaauauga

SEQ ID NO: 76792 - RNA, 2190 nt, Artificial Sequence
  P07766
gcacuaaucgcauuuuuagcauuccuuauaauaguuacaaguauagcauuauuagucguacucuauaaaaucuacgaucuacauaagaaaagaucaugcaacuuagacgaacaacaagagcuaguagaaagagacgaugaaaaacaauuaaugaacguagaaccaauacacgcggauauccuacuagaaaccuacaaaagaaaaauagcagaugaaggaagauuauuccuagcagaauuucaaagcauaccaagaguauuuaguaaauucccaaucaaagaagcuagaaaaccauucaaucaaaauaaaaaccgauacguagacauccuaccuuaugauuacaauagaguagaacucucugaaauuaauggcgaugcaggaucaaauuacauaaacgcaucauacauagacggauucaaagaaccucguaaauacauagcagcucaaggccccagagaugaaacaguggacgacuucuggagaaugauaugggaacaaaaagcaacagucauagucaugguaacaagaugcgaggaaggaaacagaaauaaaugcgcagaauacuggccauccauggaagaaggaacucgugccuucggagacguaguaguaaaaauaaaucaacacaaacgaugcccagauuacauaauccaaaaauuaaauaucgucaauaagaaagaaaaagcaacaggacgcgaaguaacucauauccaauucacaaguuggccagaccacggcguaccagaagacccacaccuauuacucaaacuaagaagaagaguaaaugcauuuagcaacuucuucagcggaccaauuguaguucacuguagugccgguguaggccguacagggacauacauagggauagacgcaauguuagaaggauuagaggcagaaaacaaaguagacguuuacgguuauguuguaaaacuaagaagacaacgaugcuuaaugguccaaguagaagcccaauacauccuaauacaucaagcucuagucgaguauaaccaauucggcgaaacagaagucaacuuaucugaauugcacccauauuuacacaauaugaagaaaagggauccaccuuccgaaccaucuccauuagaagcagaguuccaacgacuaccaaguuacagaagcuggagaacacaacacauaggaaaccaagaagaaaacaaaaguaaaaaucggaauagcaauguaauaccuuacgauuauaaccgagugccuuuaaaacaugaauuagaaaugaguaaagaaagcgaacacgacucggacgaaagcucagacgacgacucagauagcgaagaaccauccaaauauauaaaugcaucauuuauuaugaguuacuggaaaccagaaguaaugauagcagcucaaggcccccuaaaagaaacaauaggagacuucuggcaaaugauauuucaaagaaaaguuaaaguaauagucaugcuaacagaauuaaaacacggugaccaagaaauaugugcacaauacuggggugaaggaaaacaaacauacggagacauagaaguagaccuaaaagauacggacaaaucuuccacuuacacucuuagaguguuugaacuaagacacucaaaaagaaaagacaguagaacaguauaccaauaccaauauacaaacuggagcguagaacaacuaccggcagaacccaaagaacuaauuucaaugauacaagucguaaaacaaaaauuaccacagaaaaacuccagugaaggaaauaaacaccauaaaucaaccccucuauuaauacacuguagagauggcagccaacaaacaggaauauuuugcgcacugcuaaacuuauuagaaagcgcagaaacagaagaaguaguagauauauuccaagucguaaaagcacuaagaaaagcgagaccagguaugguaucuacauucgaacaauaccaauuucuauacgauguaauagccagcacauaccccgcucaaaacggucaaguaaagaaaaauaaccaucaagaggauaaaaucgaauuugauaacgaaguagacaaagucaaacaggaugcuaacugcguuaacccauuaggugcacccgaaaaauuaccagaagcaaaagaacaagccgaaggaucagaaccgaccucagguacugaaggcccagaacacuccguaaacggaccagccaguccagcacuaaaccaaggaucauga

SEQ ID NO: 76793 - RNA, 141 nt, Artificial Sequence
  P08575
guaucauuuugccuaguaaugguauuacuauuugcaguagacacaggauuauacuucagcguaaaaacaaacauaagaagcagcacaagagacuggaaagaccauaaauuuaaauggagaaaagacccacaagauaaauga

SEQ ID NO: 76794 - RNA, 207 nt, Artificial Sequence
  P08637
uucuggguauuaguaguaguaggaggaguacuagcaugcuauagccuauuaguaacaguagcauuuauaauauucuggguaagaagcaaaagaucaagauuacuacauagcgauuacaugaacaugacaccaagaagaccaggaccaacaagaaaacacuaucaaccauacgcaccaccaagagauuucgcagcauauagaucauga

SEQ ID NO: 76795 - RNA, 252 nt, Artificial Sequence
  P10747
auaauaacagcagaaggaauaauauuacuauucugcgcaguaguaccaggaacauuacuauuauucagaaaaagauggcaaaacgaaaaauuaggacuagacgcaggagacgaauaugaagacgaaaaucuauaugaaggacuaaaucuagaugacuguaguauguacgaagacauaagcagaggacuacaaggaacauaucaagacguaggaagccuaaacauaggagacguacaacuagaaaaaccauga

SEQ ID NO: 76796 - RNA, 798 nt, Artificial Sequence
  P11912
guaagugcaguaacauuagcauaucuaauauuuugucuauguucauuaguaggaauuuuacauuuacaaagagcuuuaguacuaagaagaaaaagaaaaagaaugacagauccaacaagaagauuuuuuaaaguaacuccaccuccaggaucaggaccacagaaucaauauggaaauguuuugaguuuaccaacaccaacaagcggauuaggaagagcacaaagaugggcagcuggauuaggaggaacagcaccaucauauggaaauccaucaagcgauguacaagcugauggagcauuaggaagcagaagcccaccaggaguaggaccagaagaagaagaaggagaaggauaugaagaaccagauucagaagaagauucagaauuuuaugaaaaugauaguaaucuaggacaagaucaauuaagccaagauggaucaggauaugaaaauccagaagaugaaccauuaggaccagaagaugaagauucauuuagcaaugcagaaaguuaugaaaaugaagaugaagaauuaacacaaccaguagcaagaacaauggauuuuuuaagcccacauggcucagcaugggauccuaguagagaagcaacaucauuaggaagccagaguuaugaagauaugagaggaauauuauaugcagcaccccaauuaagaucaauaagagggcaaccaggaccaaaucaugaagaagaugcagauucauaugaaaauauggauaacccagauggaccugauccagcauggggaggaggaggaagaaugggaacauggucaacaagauga

SEQ ID NO: 76797 - RNA, 189 nt, Artificial Sequence
  P15391
uuccuccuauggauacucgcagccguauccucaggccuauucuucuacucauuccuacucacagccguaucccuauccaaaaugcuaaaaaaacgcucaccccuaaccacaggcguauacguaaaaaugcccccaaccgaacccgaaugcgaaaaacaauuccaacccuacuucauacccauaaacuga

SEQ ID NO: 76798 - RNA, 219 nt, Artificial Sequence
  P16410
augggauggauaagaggaagaagaagcagacacucaugggaaaugucagaauuucacaauuacaauuuagauuuaaaaaaaucagacuucagcacaagauggcaaaaacaaagaugcccaguaguaaaaucaaaaugcagagaaaacgcaagcccauucuuuuucugcuguuuuauagcaguagcaaugggaauaagauucauaauaaugguagcauga

SEQ ID NO: 76799 - RNA, 192 nt, Artificial Sequence
  P16671
cuaugcuacauacuagacgcaauacuauuccuauacggaauaguacuaacacuacuauacugcagacuaaaaauacaaguaagaaaagcagcaauaacaagcuacgaaaaaagcgacggaguauacacaggacuaagcacaagaaaccaagaaacauacgaaacacuaaaacacgaaaaaccaccacaauga

SEQ ID NO: 76800 - RNA, 213 nt, Artificial Sequence
  P26718
ggaauaauaaugauacaaacacuacuaauaauacuauucauaauaguaccaauauuccuacuacuagacaaagacgacucaaaagcaggaauggaagaagaccacacauacgaaggacuagacauagaccaaacagcaacauacgaagacauaguaacacuaagaacaggagaaguaaaauggucaguaggagaacacccaggacaagaauga

SEQ ID NO: 76801 - RNA, 249 nt, Artificial Sequence
  P30273
uggauaacagcaguacuaccaacaguaauaauaugcguaaugguauucugccuaauacuauggaaauggaaaaaaaaaaaaagaccaagaaacucauacaaaugcggaacaaacacaauggaaagagaagaaagcgaacaaacaaaaaaaagagaaaaaauacacauaccagaaagaucagacgaagcacaaagaguauucaaaagcucaaaaacaagcucaugcgacaaaucagacacaugcuucuga

SEQ ID NO: 76802 - RNA, 249 nt, Artificial Sequence
  P32248
ggaggaacaguacuacuacuacuauucguaauaucaauaacaacaauaauaguaauauuccuaaacagaagaagaagaagagaaagaagagaccuauucacagaaucaugggacacacaaaaagcaccaaacaacuacagaucaccaauaagcacaagccaaccaacaaaccaaagcauggacgacacaagagaagacauauacguaaacuacccaacauucagcagaagaccaaaaacaagaguauga

SEQ ID NO: 76803 - RNA, 303 nt, Artificial Sequence
  P40259
cuaguaggagcaggaguaguacuaaugcuaauaauacuaguagcacuacuaaugcuaguauucagaucaaaaagagaaguaaaaagacaaaaauacagacuaagccaacuauacaaauggcaagaagaagacucaggaccagcaccaggaacauuccaaaacauaggauucgacauaugccaagacgacgacucaauacaccuagaaucaauauacucaaacuuccaaccaucacuaagacacauagacccagaaacaaaaauaagaauacaaagaccacaaguaaugacaacaucauucuga

SEQ ID NO: 76804 - RNA, 177 nt, Artificial Sequence
  P42081
augagcgacucaaaagaaccaagacuacaacaacuaggacuacuagaagaagaacaauuaagaggacuaggauucagacaaacaagaggauacaaaagccuagcaggaugccuaggacacggaccauuaguacuacaacuacuaucauuuacauuacuagcaggacuauuaguauga

SEQ ID NO: 76805 - RNA, 645 nt, Artificial Sequence
  Q15762
gcaguaauacuauucuucuucacauucuucauaacaacaaugguaaugcuagcagcacucgcccaccaccuauucuacugggauguaugguucauauacaacguaugccuagcaaaaguaaaaggauacagaucauuaucuacaucacaaacauucuacgacgcauacauaucauacgacacuaaagacgcaucaguaacagacuggguaauaaaugaacucagauaccaccuagaagaaucaagagacaaaaacguauuacuaugccuagaagaaagagacugggacccaggacuagcaaucauagacaaccuaaugcaaucaauaaaccaaucaaaaaaaacaguauuuguacuaacaaaaaaauacgccaaaucauggaacuucaaaaccgcauucuaccuagcccuacaaagacuaauggacgaaaacauggacguaauaauauucauacuacuagaaccaguauuacaacacucacaauaccuaagacuacgacaaagaauaugcaaaucauccauacuacaauggccagacaacccaaaagcagaaggccuauucuggcaaacacucagaaacguaguccuaacagaaaacgacucacgauacaacaacauguacguagacucaauaaaacaauacuga

SEQ ID NO: 76806 - RNA, 102 nt, Artificial Sequence
  Q685J3
cuauuaggauuaauagaaaugauacuauuaagcguaggaguaguaauguucguagcauuuaugauaagcuauugcgcaugcagaagcaaaacaauaaaauga

SEQ ID NO: 76807 - RNA, 120 nt, Artificial Sequence
  Q9NNX6
gauagauauguagcaauaguacaagcaguaucagcacauagacauagagcaagaguacuauuaauaucaaaauuaagcuguguaggaauauggauauuagcaacaguauuaagcauauga

SEQ ID NO: 76808 - RNA, 129 nt, Artificial Sequence
  Q9NR97
agaacacuauuacaagcaagaaauuucgaaagaaauaaagcaauaaaaguaauaauagcaguaguaguaguauucauaguauuucaacugccauauaacggaguaguacuagcacaaacaguagcauga

SEQ ID NO: 76809 - RNA, 105 nt, Artificial Sequence
  A0A5B9
accauccuguacgagauucuccugggcaaggccacuuuguaugcagugcuggucagcgcccucgugcugauggcgaugguaaaaaggaaggacucccggggguga

SEQ ID NO: 76810 - RNA, 75 nt, Artificial Sequence
  B7Z8K6
cugggccucaggaugcuguucgccaagaccguggcagucaacuuuuugcugacugccaaacucuucuuucuguga

SEQ ID NO: 76811 - RNA, 627 nt, Artificial Sequence
  B9A064
accaucauuggcgugagcguccuguccgugcucguagugagugucguggccgugcuggucuacaaguucuauuuucacuugaugcugcucgcagggugcaucaaauacgguaggggcgagaacauuuaugacgccuucgugaucuacagcucccaggaugaagacuggguacggaaugagcuggugaagaacuuggaagagggggugcccccauuucaacugugucuccauuaucgcgauuucauuccgggcguggcgaucgccgcaaauaucauucacgaagguuuucauaaaaguaggaaggugaucgucgugguaagccagcacuucauucagucccgguggugcaucuuugaguacgagauugcccagacuuggcaauuccugagcucccgcgcagggaucauuuuuaucgugcugcagaaagucgaaaagacccuccugaggcagcaggucgaguuguaucggcugcucagucgcaacacguaccuggaaugggaggacagcgugcugggcaggcauaucuucuggcggcgcuugaggaaggcccuccuggauggcaaauccuggaaucccgaggggacugucgguaccggcuguaacuggcaagaagcgaccagcauuuga

SEQ ID NO: 76812 - RNA, 189 nt, Artificial Sequence
  O00206
auggcccugaucgugcucggcggggucgcaggucuguugcuguucauuggccucgggaucuuuuucugcgugaggugucggcaccgcaggcggcaggccgaacgcaugagccaaauuaagaggcuguuguccgagaaaaagaccugccaguguccccaucgguuucagaaaacuugcaguccaaucuga

SEQ ID NO: 76813 - RNA, 84 nt, Artificial Sequence
  P01730
auccugcucggcaaggccacccuguacgcaguguuggucagcgcccuggugcucauggcgaugguaaaaaggaaggacuucuga

SEQ ID NO: 76814 - RNA, 246 nt, Artificial Sequence
  P01850
gugaugagcgucgccaccaucgugauuguagacaucugcauuacuggcgggcugcuccuguugguguacuauugguccaagaacaggaaagcaaaggccaaacccgucacccggggugcgggcgccgggggccgccagaggggucaaaauaaggagcggccaccgcccgugccaaaccccgauuacgaaccaauccgcaaagggcagagggaccuguauaguggccucaaucagcggcgcauuuga

SEQ ID NO: 76815 - RNA, 2190 nt, Artificial Sequence
  P07766
gcccugaucgcauuccucgccuuucugauuaucgugaccagcauugcguugcuggucgugcucuacaagaucuaugaccugcacaaaaagagguccugcaacuuggaugagcagcaagaacugguagagcgggacgaugaaaaacagcucaugaauguggagcccauucaugccgacauccugcuggaaacuuacaagcgcaaaaucgcagaugagggcaggcucuuucuggccgaguuucagaguauuccacgggucuucagcaaguuuccgaucaaggaagcacgcaaacccuucaaccagaauaagaacagguauguggacauuuugccauacgauuauaaucggguggagcuguccgaaaucaacggggacgccgguaguaauuacauuaacgcgagcuauaucgauggcuuuaaagagccccgcaaguacauugccgcacaagggccaagggacgagaccgucgaugacuucuggcggaugaucugggaacagaaagccacggugaucguaauggugacucgcugugaggaaggcaauaggaacaagugcgccgaguacuggcccuccauggaagaggguacccgggcauuuggggaugucguggugaaaauuaaucagcacaagcgcuguccagacuauaucauucagaagcucaacaucgucaauaaaaaggagaaagccaccggcagggaagugacucauauucaauucaccagcuggccggaccacggcguacccgaggauccacaucugcuguugaagcuccggcgcagggugaacgcguuuuccaauuucuucagugggcccaucgucgugcacugcagcgccggugugggccggacggggacuuacaucggcauugacgcaaugcuggaaggucuggaggccgaaaacaaagucgauguguauggguacguagugaagcuccgcaggcagcggugucugaugguccagguggaggcacaguauaucuugauucaccaagcccuggucgaguacaaccaguuuggcgaaaccgaggugaaucucuccgaacugcauccauaucugcacaacaugaagaaaagggaucccccgagcgagcccaguccauuggaagccgaguuccagcgccuccccuccuaccggagcuggaggacucaacauaucggcaaucaggaggaaaacaaguccaaaaaucgcaacaguaaugugauuccauacgacuauaaccggguaccccugaagcacgagcuggaaaugagcaaagaguccgagcacgacagcgaugaaaguuccgacgaugacagcgauagugaggaaccauccaaguacaucaaugcgagcuuuaucaugagcuauuggaagccggaggugaugauugcagcccaggggccccucaaagaaaccaucggugacuucuggcagaugauuuuucaaaggaaggucaaagugaucgucaugcugaccgaguugaagcauggcgaccaggagauuugcgcccaguacuggggcgaagggaaacagacguauggugauaucgagguggaccugaaggauacugacaaguccaguaccuacacucuccgcguguucgaacugcggcacagcaaaaggaaggauucccggaccguauaucaauaccaguacaccaacuggagcguggagcagcugccagcagaacccaaagaguugauuaguaugauccaggucgugaagcaaaaacucccacagaaaaauuccagcgagggcaacaagcaucacaaguccacuccccugcugauccauugucgcgacgggagucagcagacgggcauuuucugcgcccuccugaauuugcuggaaagcgcggagaccgaagaggucguggauaucuuccaagugguaaaggcccucaggaaagcacggccggggauggucuccacuuuugaacaguaucaguuccuguacgacgugauugccagcaccuauccagcacaaaacggucaggugaagaaaaauaaccaccaggaggauaagaucgaguuugacaacgaagucgauaaagugaagcaggacgccaauugugugaacccccugggcgcccccgagaaguugccagaagcaaaagagcaagccgaggggagugaacccaccuccggcacugaggguccagaacacagcguaaauggcccggcgucccccgcccugaaccaggggaguuga

SEQ ID NO: 76816 - RNA, 141 nt, Artificial Sequence
  P08575
gugagcuucugccuggucauggugcuccuguuugccguagacaccggcuuguacuucuccgugaagacuaacaucaggaguagcacccgggauuggaaagaccacaaguuuaaauggcgcaaggauccccaggacaaauga

SEQ ID NO: 76817 - RNA, 207 nt, Artificial Sequence
  P08637
uucugggugcuggucgugguaggcggggugcucgccugcuacagccuguuggucaccguggcauuuaucauuuucugggugagguccaagcggagucgccugcuccacagcgacuauaugaacaugacucccaggcggccagguccgacccgcaaacauuaccagcccuaugccccacccagggauuuugcggccuaccgguccuga

SEQ ID NO: 76818 - RNA, 252 nt, Artificial Sequence
  P10747
aucauuaccgccgagggcaucauucuccuguucugcgcagugguccccgggacucuguugcuguuuaggaagcgguggcagaacgaaaaacucggucuggacgccggcgaugaguacgaagacgagaauuuguaugaagggcugaaccucgaugacuguagcauguacgaggauaucucccgcggccugcaagguaccuaucaggacguggggagucugaauauuggcgauguacagcucgagaagccauga

SEQ ID NO: 76819 - RNA, 798 nt, Artificial Sequence
  P11912
gugagcgccgucacccuggcauaccucaucuucugccuguguuccuuggugggcauucugcaccuccagagggcccugguauugcggcgcaagaggaaacggaugacugaccccacccgcagguuuuucaaggugacgccaccgcccgggagugguccacaaaaccaguauggcaauguccugagccuccccacuccaaccuccgggcugggccgggcgcagcgcugggccgcaggucugggcgggaccgcccccaguuacgggaacccaagcuccgaugugcaggcagacggggcccucgguagcagguccccgcccggcguggggccagaggaagaggaaggcgaggguuaugaggaacccgauagugaggaagacagcgaguuuuacgaaaaugauuccaaccuggggcaagaccaguugagccaggauggcaguggcuaugagaauccagaggacgaaccccuggggccggaggaugaagacuccuucagcaacgcggaguccuacgaaaaugaggaugaggaacucacucagcccgucgcccggaccauggacuuucugaguccacaugguagcgcaugggaucccucccgcgaggccacgagccugggcagucaauccuaugaagacaugagggggaucuuguacgccgcaccacagcuccggagcauucgcggccagcccgguccaaaccacgaggaagacgccgauaguuacgagaauauggacaacccggauggccccgacccagcguggggcggcggggguaggaugggcacuugguccacccgguga

SEQ ID NO: 76820 - RNA, 189 nt, Artificial Sequence
  P15391
uuccugcucuggauccuggccgcagugagcuccggcuuguuuuucuacaguuuucugcucaccgccgucagccuguccaagauguugaaaaagaggaguccccugacuaccgggguguauguaaaaaugccaccgacggagcccgaaugcgagaagcaguuccaaccauacuuuauucccaucaacuga

SEQ ID NO: 76821 - RNA, 219 nt, Artificial Sequence
  P16410
augggcuggaucagggggcggcgcagcaggcacuccugggagaugagugaguuccauaacuacaaucuggaccucaagaaaagcgauuuuuccacccgguggcagaagcaacgcugccccguggucaaaaguaaguguagggaaaacgccagcccauucuuuuucugcuguuuuauugcaguggccauggguauccgguucauuaucaugguagcguga

SEQ ID NO: 76822 - RNA, 192 nt, Artificial Sequence
  P16671
cugugcuacauccucgacgccauucuguucuuguauggcaucgugcugacccuccuguacuguagguugaagauucagguccggaaagcagccaucacuagcuaugagaaguccgaugggguguacaccggucugaguacgcgcaaccaagaaacuuaugagacccucaaacacgaaaagcccccacaguga

SEQ ID NO: 76823 - RNA, 213 nt, Artificial Sequence
  P26718
ggcaucauuaugauccagacccugcucauuauccuguucauuaucgugcccaucuuuuugcugcucgacaaggaugacagcaaagccgggauggaggaagaucacacuuacgagggucuggacauugaucaaaccgcaacguaugaagacaucgucacuuugaggaccggcgaggugaagugguccguaggggaacauccaggccaggaguga

SEQ ID NO: 76824 - RNA, 249 nt, Artificial Sequence
  P30273
uggaucaccgccgugcugcccacugucauuaucugcgugaugguauucugucucauucuguggaaguggaaaaagaaaaagaggccacggaacagcuacaaaugcggcaccaauacgauggagcgcgaagaguccgaacagacuaagaagagggagaaaauccacauuccggaacggagugacgaggcacaacgcguguuuaagagcuccaaaaccaguagcugugacaaguccgauaccugcuucuga

SEQ ID NO: 76825 - RNA, 249 nt, Artificial Sequence
  P32248
ggcgggaccgugcugcuccuguuguucgucaucagcauuacuaccaucauugugaucuuucugaacaggcggcgcaggcgggagcgcagggaccucuucacggaauccugggauacucagaaggcccccaauaacuaccggaguccaauuagcaccucccaaccgaccaaucagaguauggacgauacucgcgaggacaucuauguaaacuaccccaccuuuagcaggcggccaaaaacgcgcguguga

SEQ ID NO: 76826 - RNA, 303 nt, Artificial Sequence
  P40259
cuggugggcgccggggucgugcucaugcugaucauuuugguagcacugcucaugcugguguucaggagcaagcgggaggucaaacgccagaaguacagguugucccaacuguauaaauggcaggaagaggacaguggucccgccccaggcaccuuucagaacaucggguucgauauuugccaggacgaugacagcauccaccucgaauccauuuacaguaauuuucaaccgagccugcggcauaucgaucccgagacuaagauccgcauucagaggccacaggugaugaccacguccuucuga

SEQ ID NO: 76827 - RNA, 177 nt, Artificial Sequence
  P42081
augagcgacuccaaggagcccaggcugcagcaacucggccuguuggaagaggaacagcugcgggggcucgguuuccgccagaccaggggcuacaaaagucuggccgggugcuugggccacgguccacuggugcuccagcugcugagcuuuacucuccuggcaggguugcuggucuga

SEQ ID NO: 76828 - RNA, 645 nt, Artificial Sequence
  Q15762
gccgugauccuguucuuuuucaccuuuuucauuacuaccauggucaugcucgcagcccuggcgcaccauuuguuuuacugggacgugugguucaucuauaacguaugccuggccaaggugaaaggcuacaggagccucuccacgagucagacuuuuuaugaugcauacauuagcuaugacaccaaggaugccuccgucaccgacugggugaucaaugagcugcgguaccacuuggaagagagucgcgauaaaaacgugcugcucugucuggaagagagggacugggaucccgggcuggcaauuaucgacaaucucaugcaaagcaucaaccaguccaagaaaacugucuucgugcugaccaagaaguaugccaaaagcuggaauuuuaagacggcguucuacuuggcccugcagcggcucauggaugaaaacauggacguaauuaucuuuauucugcuggagccaguguugcagcauucccaauaccuccgccugaggcagcggaucugcaaaaguagcauucugcaguggccggauaaucccaaggcagagggucucuucuggcagacucugcgcaacgucguguugaccgaaaaugacuccagguauaacaauauguacguggauagcaucaaacaauauuga

SEQ ID NO: 76829 - RNA, 102 nt, Artificial Sequence
  Q685J3
cugcucggccugaucgagaugauuuugcugagcgugggggucgugauguucguagccuuuaugaucuccuacugcgcauguaggaguaagaccauuaaauga

SEQ ID NO: 76830 - RNA, 120 nt, Artificial Sequence
  Q9NNX6
gacagguacguggccaucguccaggcagugagcgcccaccggcaucgcgcgaggguacugcucauuuccaagcugaguugcgugggcaucuggauuuuggccaccguccugagcaucuga

SEQ ID NO: 76831 - RNA, 129 nt, Artificial Sequence
  Q9NR97
aggacccugcuccaggcccggaacuucgagcgcaauaaggcaaucaaagugauuaucgccgucgugguaguguuuauugucuuccaacugcccuacaacggcgugguguuggcgcagacugucgccuga

SEQ ID NO: 76832 - RNA, 105 nt, Artificial Sequence
  A0A5B9
accauccucuacgaaauccuacucggcaaagccacacucuacgccguccucgucuccgcccucguacucauggccauggucaaacgcaaagacucacgcggcuaa

SEQ ID NO: 76833 - RNA, 75 nt, Artificial Sequence
  B7Z8K6
cucggccuccgcaugcucuuugccaaaaccgucgccgucaacuuucuccuaaccgccaaacuauucuuucucuga

SEQ ID NO: 76834 - RNA, 627 nt, Artificial Sequence
  B9A064
acaaucauaggcguauccguacuauccguacuagucgucucagucgucgcaguccucguuuacaaauucuacuuccaccuaaugcuccucgccggcugcaucaaauacggacgaggcgaaaacaucuacgacgcauucgucaucuacuccucccaggacgaagacuggguccgcaacgaacucguuaaaaaccucgaagaaggcgucccccccuuccaacuuugccuccacuaccgagacuucauacccggcgucgccaucgcagcaaacauaauccacgaaggcuuccacaaaucucgcaaagucaucgucguagucucacaacacuucauacaaucacgauggugcaucuuugaauacgaaaucgcacaaaccuggcaauuccuguccucacgcgcaggcaucaucuucauaguacuccaaaaagucgaaaaaacccuccuccgccaacaagucgaacucuaccgccuccucucccgcaacaccuaccuagaaugggaagacuccguccucggccgacacaucuucuggcgccgacucaggaaagcccuccuagacggcaaauccuggaaccccgaaggcaccguagguaccggcugcaacuggcaagaagccacaucaauauga

SEQ ID NO: 76835 - RNA, 189 nt, Artificial Sequence
  O00206
auggcacucauaguccugggcggagucgcaggccuacuccuguucauaggccuaggcauauucuucugcguacgcugccgccaccgcagacgccaggccgaacgcaugagccagaucaaacgacuacucucagaaaagaaaacgugccagugcccacacagauuccagaaaacgugcucacccauauga

SEQ ID NO: 76836 - RNA, 84 nt, Artificial Sequence
  P01730
auccuccucggcaaagccacccucuacgccguacucgucuccgcccucguacucauggccauggucaaacgcaaagacuucuga

SEQ ID NO: 76837 - RNA, 246 nt, Artificial Sequence
  P01850
gucaugucaguagccaccaucguaaucgucgacauaugcaucaccggcggccuccuccuccucguauacuacuggucaaaaaaccgaaaagccaaagccaaacccguaacccgaggcgcaggcgccggcggccgccaacgcggacaaaacaaagaacgcccaccacccguccccaacccagacuacgaacccauccgaaaaggacaacgcgaccucuacucaggccucaaccaacgccgaaucuga

SEQ ID NO: 76838 - RNA, 2190 nt, Artificial Sequence
  P07766
gcccuaaucgcauuuuuggccuuccuaaucauaguaaccagcaucgccuugcugguaguccuauacaaaauauacgaccuccacaagaaacguagcugcaaucuugacgaacaacaggagcuagucgaacgagacgacgaaaaacaacucaugaacgucgaaccgauccaugccgacauccuccuagaaacguacaaaagaaaaaucgccgacgaaggccgacuauuccuugcggaguuccaauccauacccagagucuucuccaaauucccaaucaaagaagcuagaaaacccuucaaucaaaacaaaaaccgcuacgucgacauacuaccauacgacuacaacagggucgaauuaucugaaaucaacggcgacgccgguuccaacuacaucaacgcaucguacauagacggcuucaaagaaccccgcaaauacauagcagcccaaggaccucgagacgaaacgguagacgauuucuggcgcaugaucugggaacaaaaagcgaccgugaucgucauggucacgcgcugcgaagaaggcaaccgcaacaaaugcgccgaauacuggccgagcauggaagagggcacucgcgccuucggagacguaguaguaaaaauuaaccaacacaaacguugcccagacuacauaauacaaaaacucaacaucguaaacaaaaaggagaaggcuacaggacgcgaagucacccacauacaauucacauccuggcccgaccacggcguaccggaagacccacaucugcuccugaaacuccggagacguguaaacgccuucuccaacuucuuuagcggacccauaguuguccacugcagcgccggaguaggccgcaccgguacauacaucggcaucgacgcgaugcuagaaggccuggaagcagaaaacaaagucgacgucuauggauacgucguaaaguuacgccgccaacgcugccucaugguccaagucgaggcccaauacauccucauacaccaagcccuugucgaauacaaccaauucggcgaaacagaggucaaccucucagaacuccaccccuaccuacacaacaugaagaaacgggacccacccagcgaacccucaccccuggaagccgaguuccaacgccucccaagcuaccgcuccuggcgcacccaacacauagggaaccaagaagagaacaaauccaaaaaccgcaauuccaacgucauaccauacgacuacaaccgagucccacugaaacacgaacucgaaauguccaaagagucagaacacgacagcgacgaaucauccgacgacgacagcgacuccgaagaacccagcaaauauaucaacgcaucauucauaaugagcuacuggaaaccggaagucaugauagccgcacaggggccccuaaaagaaaccaucggagacuuuuggcaaaugauauuccaacgcaaggucaaagucauagugauguugaccgagcuuaaacacggcgaccaagaaaucugcgcgcaguacuggggagaagguaagcaaaccuacggcgacaucgaaguagaucucaaagacacugacaaaagcucaaccuacacacuacgaguauucgaauuacggcacucaaaaagaaaagacagccgcacgguauaccaauaccaauacacaaacuggagcgucgagcaacucccggcugagccaaaagaacucauauccaugauccaaguagucaaacaaaagcuaccccagaaaaacuccagcgaaggcaacaagcaccacaaauccacaccgcuccuaauacauugcagggacggcagccaacagacaggcaucuucugcgcccuccuuaaucuccucgaaagcgccgaaaccgaagaaguaguagacaucuuccaaguaguaaaagcacuccgaaaagcccggccaggaauggucucaacauuugaacaauaccaauuccuauacgacguaauagcgagcaccuacccggcacaaaacggccaagugaagaaaaacaaccaccaagaagacaaaaucgaguucgauaacgaagucgacaaaguaaaacaggacgccaacugcgucaacccccuaggagccccagaaaaacuccccgaagcgaaagaacaagcagaaggaucagaaccaacgagcgguaccgagggcccagaacacagcguaaacggcccggccucgcccgcacuaaaccaaggcagcuga

SEQ ID NO: 76839 - RNA, 141 nt, Artificial Sequence
  P08575
gucagcuucugcuuaguaaugguccuacucuucgccguagacacgggccuguacuucagcgugaaaacaaacauacgcucgagcacacgcgacuggaaggaccacaaauucaaauggcgcaaggacccgcaagacaaauga

SEQ ID NO: 76840 - RNA, 207 nt, Artificial Sequence
  P08637
uucuggguccucgucguagucggaggcguccucgccugcuauucccuacucgucaccgucgccuucauaauauucugggucagauccaaacgcucacgccuacuccacuccgacuacaugaacaugaccccacgcagacccggaccaacccgcaaacacuaccaaccauacgcacccccacgcgacuucgcagccuaccgcucauga

SEQ ID NO: 76841 - RNA, 252 nt, Artificial Sequence
  P10747
aucauaaccgcagaaggcaucauccuccuauucugcgcagucguccccggcacccuccuacucuuccgaaaacgcuggcaaaacgaaaaacucggccucgacgccggagacgaauacgaagacgaaaaccuauacgaaggacucaaccuagacgacugcucaauguacgaagacaucucccgcggccuacaaggcaccuaccaagacgucggcucacucaacaucggcgacguccaacuagaaaaacccuga

SEQ ID NO: 76842 - RNA, 798 nt, Artificial Sequence
  P11912
guaagcgcagucacacuagcauaccucauauucugccuaugcucacucgucggaauccuccaccuccaacgagcacucgugcucagacgcaagcgcaaacgaaugaccgaccccacacgccgauucuucaaagucaccccaccccccggcucaggcccacaaaaccaauacggcaacguccuaagccuacccacccccacgagcggacucggacgcgcacaaagaugggccgccggacucgggggcacagcaccauccuacggaaaccccucaagcgacguacaagcagacggcgcacuaggaucccgauccccccccggagucggcccagaagaagaagaaggagaaggauacgaagaaccagacucagaagaagacuccgaauucuacgaaaacgacucaaaccucggccaagaccaacucagccaagacggaagcggcuacgaaaacccagaagacgaaccccucggacccgaagacgaagacuccuucuccaacgcagaauccuacgaaaacgaagacgaagaacuaacacaacccguagccagaaccauggacuuccucucgccacacggcucagccugggacccgagcagagaagccacaucccucggaagccaauccuacgaagacaugcgaggcauccucuacgccgccccacaacuccgaagcauacgcggacaacccggccccaaccacgaagaagacgcagacucauacgaaaacauggacaacccagacggcccagaccccgccuggggaggaggcggccgcaugggcacauggucgacccgauga

SEQ ID NO: 76843 - RNA, 189 nt, Artificial Sequence
  P15391
uuccucuuauggauacucgccgccgucuccuccggccuauucuucuacuccuuccuacucacagccguaucccucuccaaaaugcucaaaaaacgcucaccccucaccaccggcgucuacgucaaaaugccccccaccgaacccgaaugcgaaaaacaauuccaacccuacuucauacccaucaacuga

SEQ ID NO: 76844 - RNA, 219 nt, Artificial Sequence
  P16410
augggguggauacgagggcgaaggagcaggcacucgugggagaugucggaauuucacaauuacaaucucgaucucaagaaaucggacuuuagcacgagauggcaaaagcaaaggugcccggucgugaaaucgaaaugucgcgagaacgcgagcccguucuuuuucuguugcuuuaucgcggucgcgauggggaucagguucauaauaauggucgcguga

SEQ ID NO: 76845 - RNA, 192 nt, Artificial Sequence
  P16671
cugugcuacauccuggacgcaauccuguucuuauacggaaucguacucacacuccuauacugccgccugaaaauacaagugcgcaaggccgcaaucacgagcuacgagaaaagcgacggcguauacacaggccuaagcacgcgcaaucaagaaaccuacgaaacacucaaacacgagaaaccgccccaauga

SEQ ID NO: 76846 - RNA, 213 nt, Artificial Sequence
  P26718
ggcaucaucaugauccaaacccuacuaauaauacuauucaucauaguccccauauuccuccuccuagacaaagacgacuccaaagcaggcauggaagaagaccacaccuacgaaggccucgacaucgaccaaaccgcaaccuacgaagacaucguaacccuacgcaccggcgaagucaaaugguccgucggcgaacaccccggccaagaauga

SEQ ID NO: 76847 - RNA, 249 nt, Artificial Sequence
  P30273
uggauaaccgcgguccugcccacagucauaaucugcgucauggucuucugccugauauuauggaaguggaagaaaaagaaaaggcccagaaacucguacaaaugcgggaccaauaccauggaaagagaagagagcgaacaaacgaaaaagcgcgagaaaauacacauacccgagcgcucggacgaggcccagcgcguguucaagagcucgaaaacgagcucaugcgauaaaucggacacaugcuuuuga

SEQ ID NO: 76848 - RNA, 249 nt, Artificial Sequence
  P32248
ggcggaaccguccuccuacuccuauucgucauauccaucacaacaauaaucgucauauuccucaaccgcagacgccgccgagaacgccgagaccucuucaccgaaucaugggacacccaaaaagcccccaacaacuaccgcucacccaucuccacaucccaacccacaaaccaauccauggacgacacaagagaagacaucuacgucaacuaccccaccuucucccgccgcccaaaaaccagagucuga

SEQ ID NO: 76849 - RNA, 303 nt, Artificial Sequence
  P40259
cuagucggcgccggcgucguccucaugcuaaucauccucgucgcccuacucaugcucgucuuccgauccaaacgcgaagucaaacgccaaaaauaccgacuaucccaacucuacaaauggcaagaagaagacuccggccccgcccccggcacauuccaaaacauaggcuucgacaucugccaagacgacgacuccauacaccuagaauccaucuacuccaacuuccaacccucacuccgccacauagacccagaaacaaaaauccgcauccaacgcccacaagucaugaccaccuccuucuga

SEQ ID NO: 76850 - RNA, 177 nt, Artificial Sequence
  P42081
auguccgacucaaaagaaccccgacuccaacaacucggccuacucgaagaagaacaacuccgcggccucggcuuccgccaaacccgcggcuacaaaucccucgccggcugccucggccacggcccccucguccuccaacuccuauccuucacccuacucgccggccuacucgucuga

SEQ ID NO: 76851 - RNA, 645 nt, Artificial Sequence
  Q15762
gccgucauccucuuuuucuucacauucuucaucaccaccaugguaaugcucgccgcccuagcccaccacuuauucuacugggacgucugguucaucuacaacguaugccuagccaaagucaaaggcuaccgcucccucucaaccucccaaacauucuacgacgccuacauauccuacgacacaaaagacgcuucaguaacagauugggucaucaacgaacuacgauaccaccucgaagaauccagagauaaaaacguacuccucugccucgaagaacgcgacugggaccccggccucgcaaucaucgacaaccucaugcaauccaucaaccaaucaaaaaaaaccgucuucguccucacaaaaaaauacgcaaaaucauggaacuucaaaacagccuucuaccucgcacuccaacgacucauggacgaaaacauggacgucauaaucuucauccuccuugaaccaguacuccaacacucacaauaccugcgccuccgccaacgaaucugcaaaucaucaauccuccaauggccagacaaccccaaagccgaaggccucuucuggcaaacccuacgcaacgucguccucacugaaaacgacucccgauacaauaacauguacgucgacuccaucaaacaauauuga

SEQ ID NO: 76852 - RNA, 102 nt, Artificial Sequence
  Q685J3
cucuugggcuugaucgagaugauacucuugagcguaggcguggucauguucguggccuuuaugauaagcuauugcgcgugcaggagcaagaccauaaaauga

SEQ ID NO: 76853 - RNA, 120 nt, Artificial Sequence
  Q9NNX6
gaucgcuaugucgcgaucgugcaagcggucucggcccaucgccaucgcgcgcgcgugcucuugaucucgaaauugagcugugucgggaucuggaucuuggccacggucuugagcauauga

SEQ ID NO: 76854 - RNA, 129 nt, Artificial Sequence
  Q9NR97
cgcacacucuugcaagcgcgcaauuucgagcgcaauaaagcgaucaaggucauaaucgcggucguggucguguucauagucuuucaauugccauauaacggggucgugcucgcgcaaacggucgcguga

SEQ ID NO: 76855 - RNA, 105 nt, Artificial Sequence
  A0A5B9
accauacucuacgaaauacuccugggcaaggccacacucuaugccgugcucgugagcgcgcuagugcucauggccauggucaaacgcaaggacucacgcggguga

SEQ ID NO: 76856 - RNA, 75 nt, Artificial Sequence
  B7Z8K6
cucggccuacgcaugcucuuugccaaaaccgucgccgucaacuuucuccuaaccgccaaacucuucuuccucuga

SEQ ID NO: 76857 - RNA, 627 nt, Artificial Sequence
  B9A064
accaucaucggcguauccguccucucaguccuagucguaucagucgucgccguccucgucuacaaauucuacuuccaccuaaugcuacuagccggcugcaucaaauacggccgcggcgaaaacaucuacgacgccuucgucaucuacuccucacaagacgaagacuggguccgcaacgaacucgucaaaaaccucgaagaaggcguccccccauuccaauuaugccuccacuaccgcgacuucauacccggagucgccaucgccgcuaacauaauccacgaaggcuuccacaaaucccgcaaagucaucguagucgucagccaacacuucauccaaucacgcuggugcaucuucgaauacgaaauagcccaaaccuggcaauuccucuccucacgagccggaaucaucuucaucguccuccaaaaagucgaaaaaacccuccuccgccaacaagucgaacucuaccgccuccuaucccgcaacaccuaucuagaaugggaagacuccguccuaggccgccacaucuucuggcgucgacuccgcaaagcccuccucgacggcaaauccuggaacccagaaggcacagucggcaccggaugcaacuggcaagaagccaccuccaucuga

SEQ ID NO: 76858 - RNA, 189 nt, Artificial Sequence
  O00206
auggcccucaucguccucggcggcgucgccggccuacuccucuucauaggccuaggcauauucuucugcguccgcugccgccaccgccgacgccaagccgaacgcaugucccaaaucaaacgccuccucuccgaaaaaaaaacaugccaaugcccccaccgauuccaaaaaacaugcucacccauauga

SEQ ID NO: 76859 - RNA, 84 nt, Artificial Sequence
  P01730
auacucuugggcaaggccacgcucuaugccgugcuagugagcgcgcucgugcucauggccauggucaagcgcaaggacuuuuga

SEQ ID NO: 76860 - RNA, 246 nt, Artificial Sequence
  P01850
gucauguccgucgccaccaucguaaucgucgacaucugcaucaccggcggccuacuccuccucgucuacuacugguccaaaaaccgcaaagccaaagccaaacccgucacccgcggcgccggcgccggcggacgccaaagaggccaaaacaaagaaagacccccaccaguccccaacccagacuacgaaccaauccgcaaaggccaacgcgaccuauacuccggccuaaaccaacgccgcaucuga

SEQ ID NO: 76861 - RNA, 2190 nt, Artificial Sequence
  P07766
gcccuaaucgccuuccuagccuuccuuauaaucgucaccuccauagcacuccuaguaguccuauacaaaauauacgaccuccauaagaaacguuccugcaaccuagaugaacaacaagaacuugucgaaagagacgacgaaaaacaacucaugaacgucgagccgauccacgcagauauucuucucgaaaccuacaaacgcaaaauagccgacgaaggacgcuuauuccuagccgaguuccaaucaaucccccgagucuucuccaaauuccccauaaaagaagcccgcaaacccuucaaccaaaacaaaaaccgauacguagacauucuacccuacgacuauaaucgcguugaacucuccgaaauuaacggcgacgccggaagcaacuacauaaacgccucauacauagacggcuucaaagaaccaagaaaauacaucgccgcacaaggccccagagacgaaacaguggacgacuucuggcgaaugauaugggaacaaaaagccacagucaucguaauggucacacggugcgaagaaggaaaccgcaauaaaugcgcagaauauuggcccagcauggaagaaggaaccagagccuucggcgacgucguagucaagaucaaccagcacaaaaggugcccagacuacaucauccaaaaacuaaacauagucaauaagaaagaaaaagccaccggccgagaagucacgcacauccaauucacgagcuggcccgaccacggugucccagaagauccacaccuacuacucaaacuccgacgcagagucaacgcguucuccaacuucuucuccggcccgaucgucguucauugcuccgcgggagucggccguacaggcaccuacaucggcaucgacgcaaugcucgaaggacuggaagccgaaaauaaaguagacguauacggcuacguaguaaaacucaggcgccagcgcugccugaugguccaaguggaagcgcaauacauacuaauccaccaagcccucgucgaauacaaccaauucggggaaacagaaguuaaccugagcgaacuccacccauaccuccacaacaugaagaaacgcgacccacccagcgaacccucaccccucgaagcagaguuccagagauugccaucguacagaagcuggaggacccaacacauaggaaaccaggaagagaacaaaagcaaaaaccgcaacucaaacgucauccccuaugauuacaaccgugucccccucaaacacgaacucgagaugucaaaagaguccgagcacgacuccgacgaaagcuccgacgacgacagcgauucagaggagccaagcaaauacauaaacgccagcuucaucaugagcuacuggaaaccagaaguaaugaucgcagcacaaggcccccuaaaagagaccauaggcgacuucuggcaaaugaucuuccagcgcaaagugaaaguaaucgugaugcuuacagaacuaaaacacggagaccaagaaauaugcgcccaauacuggggcgaaggaaaacaaaccuacggagacaucgaggucgaccucaaagacaccgacaaauccuccaccuacacccuccgagucuucgaacuacgacacuccaagcgaaaagacagucgcacaguuuaccaguaccaauacaccaacugguccguagaacaacuccccgccgaacccaaagagcuuauauccaugauccaggucgugaaacaaaaacucccucagaaaaacagcagugagggaaacaagcaccacaaaagcacaccacuccucauacacugcagggacgguucccaacaaaccggcaucuucugcgcccugcucaaucuacucgaaagcgcugaaacagaagaagucguagacaucuuccaaguagucaaggcacucagaaaagcccgaccaggaauggucuccaccuucgaacaauaccaauuucucuaugacgucaucgcaagcacauacccugcccagaacgggcaagucaagaaaaacaaccaccaagaagacaaaauagaguucgacaacgaaguagacaaaguaaaacaagacgccaacugcguaaacccccuaggcgcaccagaaaagcuccccgaagcaaaagaacaagccgaaggaagcgaaccaacauccggcaccgaaggcccagaacacagcguaaacggccccgccucccccgcccucaaccaaggcagcuga

SEQ ID NO: 76862 - RNA, 141 nt, Artificial Sequence
  P08575
gugagcuucugccuggucaugguccuccuguucgccguagacacaggccuguacuucagcgugaaaacgaacauacgcucaagcacgcgagacuggaaagaccacaaauucaaauggcgcaaggacccgcaagacaaauga

SEQ ID NO: 76863 - RNA, 207 nt, Artificial Sequence
  P08637
uucuggguccuagucguagucggcggcguccuagcaugcuacucccuccucguaaccgucgccuucaucaucuucugggucagauccaaacgcucccgccuccuccacuccgauuacaugaacaugacaccccgcagacccggccccacccgaaaacacuaccaacccuacgcacccccacgcgacuucgccgccuaccgauccuaa

SEQ ID NO: 76864 - RNA, 252 nt, Artificial Sequence
  P10747
aucauaaccgcggaaggaaucauacucuuguucugugccgugguaccgggcacgcucuugcucuuucgcaagcgauggcaaaaugaaaagcucgggcucgaugccggggacgaguacgaggacgagaacuuguacgagggcuugaacuuggacgauugcucgauguaugaagauaucucgcgcgggcuacagggcacguaccaggacgugggcucgcuaaauaucggggacgugcaauuggaaaagccauag

SEQ ID NO: 76865 - RNA, 798 nt, Artificial Sequence
  P11912
guaagcgcggucacacuagcauaccugaucuucugccugugcucacucguaggaauacuccaccuccagcgagcauuggugcuaagacgcaagcgcaagcgcaugacagacccaacacgaagauucuucaaaguaaccccgcccccgggcucaggcccacaaaaccaauacggcaacguacuaagccuacccacaccaacgagcggacucggacgcgcacaaagaugggcagccgggcucggaggaacggccccguccuacggcaacccaucaagcgacguccaagccgacggcgcacucgggagcagaagcccacccggggucgggcccgaagaagaagaaggggaaggguacgaggaaccagacucagaagaagacucagaguucuacgaaaacgacagcaaccucgggcaagaccaacugagccaggacgggagcggguacgaaaacccggaagacgaaccgcucggacccgaagacgaagacucauucucgaacgcagaaucguacgaaaacgaggacgaagaacugacacaacccguggccaggacuauggacuuccucucaccacacggcucagccugggacccaagcagagaagcaaccucacuagggagccaaagcuacgaagacaugaggggaauacucuaugccgcgccccagcucagauccauacgcgggcaaccgggcccaaaccacgaagaagacgcagacucauacgaaaacauggacaacccagacggcccagacccagcauggggcgggggcggacgcaugggcacauggucgaccagauga

SEQ ID NO: 76866 - RNA, 189 nt, Artificial Sequence
  P15391
uuccuccuauggauccucgccgccguauccuccggccucuucuucuacucauuccuacucaccgccguaucccuauccaaaaugcucaaaaaacgcuccccccucaccaccggcguauaugucaaaaugccccccaccgaacccgaaugcgaaaaacaauuccaacccuacuucauccccaucaacuga

SEQ ID NO: 76867 - RNA, 219 nt, Artificial Sequence
  P16410
augggguggauaagagggcgcaggagcaggcacucgugggagaugucagaauuucacaauuacaaccuagaccucaagaaaucggacuuuagcacgcgcuggcaaaagcaaaggugcccggucgugaaaucgaaaugccgagagaacgcgagcccguucuuuuucugcugcuucaucgcagucgcgauggggaucagauucauaaucauggucgcguga

SEQ ID NO: 76868 - RNA, 192 nt, Artificial Sequence
  P16671
cucugcuacauacuagacgccauccucuuccucuacggaaucguccucacacuccuauacugccgccucaaaauccaaguccgcaaagccgccaucaccuccuacgaaaaauccgacggcgucuacaccggccucucaacacgcaaccaagaaacauacgaaacccucaaacacgaaaaacccccccaauga

SEQ ID NO: 76869 - RNA, 213 nt, Artificial Sequence
  P26718
ggcaucaucaugauccaaacacuacucauaauccucuucauaaucguacccaucuuccuccuccuagacaaagacgacuccaaagccggcauggaagaagaccacaccuacgaaggacuagacauagaccaaaccgccaccuacgaagacaucgucacccuacgcaccggcgaagucaaaugguccgucggcgaacaccccggccaagaauga

SEQ ID NO: 76870 - RNA, 249 nt, Artificial Sequence
  P30273
uggauaaccgcgguccugcccacggucauaaucugugucauggucuuuugccugaucuuguggaaguggaagaaaaagaaaaggcccagaaacucguacaaaugcgggaccaauaccauggaaagggaagagagcgagcaaacgaaaaagcgcgagaaaauacacauacccgagcgcucagacgaggcccagcgcguauucaagagcucgaaaacgagcucgugcgauaaaucggacacgugcuuuuga

SEQ ID NO: 76871 - RNA, 249 nt, Artificial Sequence
  P32248
ggaggcaccguccuccuccuccucuucguaaucuccaucacaaccauaaucguaaucuuccucaaccgccgccgccgacgcgaacgcagagaccuauucacagaauccugggacacccaaaaagcacccaacaacuaccgcucccccauauccaccucacaacccacaaaccaauccauggacgacacccgagaagacaucuacgucaacuacccaacauucucccgccgccccaaaacccgcgucuga

SEQ ID NO: 76872 - RNA, 303 nt, Artificial Sequence
  P40259
cuaguaggcgccggcgucguacuaaugcuaaucauacucgucgcccuccucaugcucgucuuccgauccaaacgcgaagucaaacgccaaaaauaccgccucucccaacucuacaaauggcaagaagaagacuccggacccgcccccggcaccuuccaaaacaucggcuucgacaucugccaagacgacgacuccauccaccuagaauccauauacuccaacuuccaaccaucccuccgccacaucgaccccgaaaccaaaauccgcauccaacgaccccaagucaugaccaccuccuucuga

SEQ ID NO: 76873 - RNA, 177 nt, Artificial Sequence
  P42081
auguccgacuccaaagaaccccgccuccaacaacucggccuccucgaagaagaacaacuccgcggccucggcuuccgacaaacccgcggcuacaaaucacuagccggcugccucggccacggcccccucguccuccaacuccucuccuucacccuccucgcaggccuccucgucuga

SEQ ID NO: 76874 - RNA, 645 nt, Artificial Sequence
  Q15762
gccguaauucucuucuuuuucaccuucuucaucaccaccauggucaugcucgccgcucucgcccaccaccuuuucuacugggacgucugguucaucuacaacgucugccucgcaaaaguuaaaggcuaccgaucccuaucaaccucacaaacauucuacgacgccuacaucucauacgacaccaaagaugccuccgucaccgacuggguuaucaacgaacucagauaccaccucgaagaaucccgcgacaaaaacguccuccucugcuuagaagaacgcgacugggaccccggauuagccauaaucgacaaccucaugcaauccaucaaccaauccaaaaaaaccgucuucguccuuaccaaaaaauacgcuaaauccuggaacuucaaaacagccuucuaccuagcacuccaacgacucauggacgaaaacauggacgucaucaucuucauccuccucgaacccguccuccaacacucacaauaccuccgcuuacgccaacgcaucugcaaauccuccauccuccaguggcccgacaaccccaaagccgaaggacucuucuggcaaacacuacgaaaugucguccuaaccgaaaacgacucccgcuacaacaacauguacgucgacucaaucaaacaauacuga

SEQ ID NO: 76875 - RNA, 102 nt, Artificial Sequence
  Q685J3
cuccucggccuaaucgaaaugauacuccuauccgucggcgucgucauguucguagccuucaugaucucauacugcgccugccgcuccaaaaccauaaaauga

SEQ ID NO: 76876 - RNA, 120 nt, Artificial Sequence
  Q9NNX6
gaccgcuacgucgcaaucguccaagccgucuccgcccaccgccaccgcgcccgcguccuccucauauccaaacuauccugcgucggcaucuggauccucgccacaguccuauccauauga

SEQ ID NO: 76877 - RNA, 129 nt, Artificial Sequence
  Q9NR97
cgcacgcucuugcaagcgcgcaauuucgagcgcaauaaagcgaucaaggucauaaucgcggucguggucguguucauagucuuucaauugcccuauaacggggucgugcucgcgcaaacggucgcguga

SEQ ID NO: 76878 - RNA, 105 nt, Artificial Sequence
  A0A5B9
accauacucuaugaaauacucuugggcaaggccacgcucuaugccgugcucgugagcgcgcucgugcucauggccauggucaagcgcaaggacucgcgcggguga

SEQ ID NO: 76879 - RNA, 75 nt, Artificial Sequence
  B7Z8K6
cucggccuccgcaugcucuucgccaaaaccgucgccgucaacuuccuccucaccgccaaacucuucuuccucuga

SEQ ID NO: 76880 - RNA, 627 nt, Artificial Sequence
  B9A064
accaucaucggcguauccguccucucaguccucgucgucuccgucgucgccguccucgucuacaaauucuacuuccaccucaugcuacucgccggcugcaucaaauacggccgcggcgaaaacaucuacgacgccuucgucaucuacuccucccaagacgaagacuggguccgcaacgaacucgucaaaaaccuagaagaaggcguuccacccuuccaacucugccuacacuaccgcgacuucauccccggcguagccaucgccgcaaacaucauccacgaaggcuuccacaaaucccgcaaagucaucgucgucgucucccaacacuucauccaaucccgauggugcaucuucgaauacgaaaucgcccaaaccuggcaauuccucagcucccgcgccggcauaaucuucaucguccuccaaaaagucgagaaaacccuacuccgccaacaagucgaacucuaccgccuacuaucccgcaacaccuaccuagaaugggaagacuccguccuaggccgccacaucuucuggcgccgacuccgcaaagcccuccucgacggcaaauccuggaaccccgaaggcaccgucggaaccggcugcaacuggcaagaagcuaccuccaucuga

SEQ ID NO: 76881 - RNA, 189 nt, Artificial Sequence
  O00206
auggcgcucauagucuugggcggggucgcgggcuugcucuuguucauaggcuugggcauauucuuuugcgugcgcugucgccaucgcaggcgccaggccgagcgcaugagccagaucaagcgcuugcucucggaaaagaaaacgugccagugcccgcacagguuccagaaaacgugcucgcccauauga

SEQ ID NO: 76882 - RNA, 84 nt, Artificial Sequence
  P01730
auacucuugggcaaggccacgcucuaugccgugcucgugagcgcgcucgugcucauggccauggucaagcgcaaggacuuuuga

SEQ ID NO: 76883 - RNA, 246 nt, Artificial Sequence
  P01850
gucauguccgucgccaccaucgucaucgucgacaucugcaucaccggcggccuccuccuccucgucuacuacugguccaaaaaccgcaaagccaaagccaaacccgucacccgcggcgccggcgccggcggccgccaacgcggccaaaacaaagaacgccccccccccguccccaaccccgacuacgaacccauccgcaaaggccaacgcgaccucuacucaggccucaaccaacgccgcaucuga

SEQ ID NO: 76884 - RNA, 2190 nt, Artificial Sequence
  P07766
gcgcuaaucgccuuccuggccuuccucaucauagugacaagcauagcacuccuagucguacuauacaaaaucuacgauuuacacaagaagcgcagcugcaaccucgacgaacaacaagagcuaguagaacgcgacgacgaaaagcagcuaaugaacgucgaacccauccacgcagacauccuccucgaaacguacaaacguaagauagccgacgaaggacgacuauuccucgccgaguuccaauccaucccaaggguauucagcaaauuuccaaucaaagaagcccgcaaaccauucaaccaaaacaagaacagauacguggacauccuacccuacgacuacaaucgaguagaacucagcgaaaucaacggagacgccggaucgaacuauaucaaugccucguacauagacgguuucaaagagccccgcaaauacaucgccgcgcaaggacccagagacgaaaccgucgacgacuucuggcggaugaucugggagcagaaagcuacagucaucgucaugguaaccagaugcgaggaaggcaaccgcaacaaaugcgccgaguauuggcccagcauggaagaaggcacccgggccuucggggacguagugguaaagaucaaccagcacaaacgcugccccgacuacaucauacaaaaacucaauaucguuaacaagaaagagaaagcuaccggcagggaggucacacacauacaauucaccagcuggcccgaccacggcgucccagaagacccacaccuccuacucaagcuccggcgccgagucaacgcauucagcaauuucuucucaggaccaaucgugguccauugcucagcaggagucggcaggaccgggaccuacaucgguaucgacgcaaugcuagaaggcuuagaagccgaaaacaaaguagacguguacggcuacguagucaaacucagacgccaacggugccuaaugguacaagucgaagcacaauacauacuaauacaccaggcccuaguagaauacaaucaauucggcgagaccgaggucaaccucucggaacugcaccccuaccuacacaacaugaagaaacgcgaucccccaagcgaacccucaccccuagaggcagaguuccaacgccucccauccuacaggucauggagaacccaacacauugggaaucaagaagaaaacaaaagcaaaaaccgaaacucaaacgucauacccuacgacuacaaccggguaccgcucaaacacgaacucgaaauguccaaagaauccgaacacgacagcgacgaauccuccgacgacgacuccgacuccgaagaacccuccaaguacaucaacgcauccuucauaaugaguuacuggaaacccgaagucaugauugccgcccaaggccccuugaaagaaacuauaggagacuucuggcaaaugauauuccaacgcaagguaaaaguaaucguaaugcucaccgaacucaaacacggcgaccaagaaaucugcgcccaauacuggggagaagguaaacaaaccuacggcgacaucgaagucgaucucaaggauacagacaaauccuccacauacacccuacgcgucuucgagcucagacacagcaaacgcaaagacagccgaacggucuaccaauaucaguacacaaacuggucaguggaacagcuccccgcagaaccuaaagaacucauauccaugauacaagucgucaaacagaagcucccacagaaaaacuccuccgagggcaacaaacaccacaaauccaccccacuccucauacacugucgggauggcucccaacaaacaggcaucuucugcgcacuacuaaaccuccucgaaagcgccgaaaccgaagagguuguagacaucuuccaaguggugaaagcgcuacgaaaagcccggccagggauggucucuaccuucgaacaauaccaauuccuauacgacguaauagcuuccaccuaccccgcccaaaacggacaagucaagaaaaacaaccaccaagaggacaaaauagaguucgacaacgaaguagacaaagugaaacaagacgccaacugcguaaacccucucggcgcccccgaaaaacuccccgaagcaaaagaacaagccgaaggaucagaacccaccucagggacggaaggccccgaacacuccgucaacggacccgcaucccccgcccuaaaucaagggagcuga

SEQ ID NO: 76885 - RNA, 141 nt, Artificial Sequence
  P08575
gugagcuuuugcuuggucauggucuugcucuuugccguggacacgggccuguacuucagcgugaaaacgaacauacgcucgagcacgcgcgacuggaaggaccauaaauuuaaauggcgcaaggacccgcaagauaaauga

SEQ ID NO: 76886 - RNA, 207 nt, Artificial Sequence
  P08637
uucuggguccucgucgucgucggcggcguccucgccugcuacucccuccucgucaccgucgccuucaucaucuucuggguccgcuccaaacgcucccgccuccuccacuccgacuacaugaacaugaccccccgccgccccggccccacccgcaaacacuaccaacccuacgcccccccccgcgacuucgccgccuaccgcuccuga

SEQ ID NO: 76887 - RNA, 252 nt, Artificial Sequence
  P10747
aucaucaccgccgaaggcaucauccuccucuucugcgccgucguccccggcacccuccuccucuuccgcaaacgcuggcaaaacgaaaaacucggccucgacgccggcgacgaauacgaagacgaaaaccucuacgaaggccucaaccucgacgacugcuccauguacgaagacaucucccgcggccuccaaggcaccuaccaagacgucggcucccucaacaucggcgacguccaacucgaaaaacccuga

SEQ ID NO: 76888 - RNA, 798 nt, Artificial Sequence
  P11912
guaagcgccgucacacucgcauaccucaucuucugcuuaugcucacucguaggaauacuacaccuccaacgcgcacucguccuacgacgaaaacgcaaacgcaugaccgaccccacacgccgauucuucaaaguaacccccccgccaggaucaggcccgcaaaaccaauacggcaacguccuaagccuacccaccccaaccagcggccucggacgagcccaaagaugggcagccggacuaggaggcacagcacccagcuacggcaaccccucgagcgacguccaagccgacggcgcacucggaagccggagcccccccggaguaggacccgaagaagaagaaggagaaggguacgaagaaccagacucagaagaagacucagaauucuacgaaaacgacagcaaccucggacaagaccaacucagccaagacgggagcggcuacgaaaacccagaagacgaaccacucggacccgaagacgaagacucauucucaaacgcagaauccuacgaaaacgaagacgaagaacuaacccaacccguagccaggaccauggacuuccuaucaccccacggcucagccugggacccaagcagagaagcaacaucacucggcagccaaagcuacgaagacaugcgcggaauacuauacgcagcaccccagcuuagaagcauacgaggacaacccggcccaaaccacgaagaagacgcagacucauacgaaaacauggacaaccccgacggccccgacccagccuggggcggaggcggaagaaugggaaccugguccacaagauga

SEQ ID NO: 76889 - RNA, 189 nt, Artificial Sequence
  P15391
uuccuccucuggauccucgccgccgucuccuccggccucuucuucuacuccuuccuccucaccgccgucucccucuccaaaaugcucaaaaaacgcuccccccucaccaccggcgucuacgucaaaaugccccccaccgaacccgaaugcgaaaaacaauuccaacccuacuucauccccaucaacuga

SEQ ID NO: 76890 - RNA, 219 nt, Artificial Sequence
  P16410
augggguggauacgcgggcgcaggagcaggcacucgugggagaugucggaauuucacaauuacaaucucgaucucaagaaaucggacuuuagcacgcgcuggcaaaagcaaaggugcccggucgugaaaucgaaaugucgcgagaacgcgagcccguucuuuuucuguugcuuuaucgcggucgcgauggggaucagguucauaaucauggucgcguga

SEQ ID NO: 76891 - RNA, 192 nt, Artificial Sequence
  P16671
cucugcuacauccucgacgccauccucuuccucuacggcaucguccucacccuccucuacugccgccucaaaauccaaguccgcaaagccgccaucaccuccuacgaaaaauccgacggcgucuacaccggccucuccacccgcaaccaagaaaccuacgaaacccucaaacacgaaaaacccccccaauga

SEQ ID NO: 76892 - RNA, 213 nt, Artificial Sequence
  P26718
ggcaucaucaugauccaaacccuacucaucauccucuucaucaucguccccaucuuccuccuccucgacaaagacgacuccaaagccggcauggaagaagaccacaccuacgaaggccucgacaucgaccaaaccgccaccuacgaagacaucgucacccuccgcaccggcgaagucaaaugguccgucggcgaacaccccggccaagaauga

SEQ ID NO: 76893 - RNA, 249 nt, Artificial Sequence
  P30273
uggauaaccgcggucuugcccacggucauaaucugugucauggucuucugcuugauccuguggaaguggaagaaaaagaaaaggcccaggaacucguacaagugcgggaccaauaccauggaaagggaagagagcgagcaaacgaaaaagcgcgagaaaauacacauacccgagcgcucggacgaggcccagcgcguguucaagagcucgaaaacgagcucgugcgauaaaucggacacgugcuucuga

SEQ ID NO: 76894 - RNA, 249 nt, Artificial Sequence
  P32248
ggcggcaccguccuccuccuccucuucgucaucuccaucaccaccaucaucgucaucuuccucaaccgccgccgccgccgcgaacgccgcgaccucuucaccgaauccugggacacccaaaaagcccccaacaacuaccgcucccccaucuccaccucccaacccaccaaccaauccauggacgacacccgcgaagacaucuacgucaacuaccccaccuucucccgccgccccaaaacccgcgucuga

SEQ ID NO: 76895 - RNA, 303 nt, Artificial Sequence
  P40259
cucgucggcgccggcgucguccucaugcucaucauccucgucgcccuccucaugcucgucuuccgcuccaaacgcgaagucaaacgccaaaaauaccgccucucccaacucuacaaauggcaagaagaagacuccggccccgcccccggcaccuuccaaaacaucggcuucgacaucugccaagacgacgacuccauccaccucgaauccaucuacuccaacuuccaacccucccuccgccacaucgaccccgaaaccaaaauccgcauccaacgcccccaagucaugaccaccuccuucuga

SEQ ID NO: 76896 - RNA, 177 nt, Artificial Sequence
  P42081
auguccgacuccaaagaaccccgccuccaacaacucggccuccucgaagaagaacaacuccgcggccucggcuuccgccaaacccgcggcuacaaaucccucgccggcugccucggccacggcccccucguccuccaacuccucuccuucacccuccucgccggccuccucgucuga

SEQ ID NO: 76897 - RNA, 645 nt, Artificial Sequence
  Q15762
gccgucauccucuucuucuucaccuucuucaucacaaccauggucaugcucgccgcccucgcccaccaccucuucuacugggacgucugguucaucuacaacgucugccucgccaaagucaaaggcuaccgcucccucuccaccucccaaaccuucuacgacgccuacaucuccuacgacaccaaagacgccuccgucaccgacugggucaucaacgaacuccgauaccaccucgaagaaucccgcgacaaaaacguccuccucugccucgaagaacgcgacugggaccccggccucgcuaucaucgacaaccucaugcaaucaaucaaccaauccaaaaaaacagucuucguacucaccaaaaaauacgccaaaucauggaacuucaaaaccgccuucuaccucgcccuucaacgccucauggacgaaaacauggacgucaucaucuucauccuccucgaacccguccuccaacacucccaauaccuccgccuacgacaacgcaucugcaaauccagcauccuccaauggcccgacaaccccaaagccgaaggccucuucuggcaaacccuccgcaacgucguccucaccgaaaacgacucccguuacaacaacauguacgucgacuccaucaaacaauacuga

SEQ ID NO: 76898 - RNA, 102 nt, Artificial Sequence
  Q685J3
cuccucggccucaucgaaaugauccuccucuccgucggcgucgucauguucgucgccuucaugaucuccuacugcgccugccgcuccaaaaccaucaaauga

SEQ ID NO: 76899 - RNA, 120 nt, Artificial Sequence
  Q9NNX6
gaccgcuacgucgccaucguccaagccgucuccgcccaccgccaccgcgcccgcguccuccucaucuccaaacucuccugcgucggcaucuggauccucgccaccguccucuccaucuga

SEQ ID NO: 76900 - RNA, 129 nt, Artificial Sequence; identical to SEQ ID NO: 76877
  Q9NR97

SEQ ID NO: 76901 - RNA, 105 nt, Artificial Sequence; identical to SEQ ID NO: 76786
  A0A5B9

SEQ ID NO: 76902 - RNA, 75 nt, Artificial Sequence; identical to SEQ ID NO: 76787
  B7Z8K6

SEQ ID NO: 76903 - RNA, 627 nt, Artificial Sequence
  B9A064
acaauaauaggcguaaguguauuaucgguacuaguaguaagcguaguagcaguacuaguauauaaauuuuacuuucacuuaaugcuacuagcgggcuguauaaaauauggaagaggagaaaauauauacgacgcauucguaaucuacaguucacaagacgaagacuggguaagaaaugaauuaguaaaaaacuuagaagaaggaguaccaccauuccaacuaugucuacauuacagagacuuuauaccaggaguagcaauagcagcaaacauaauacaugaaggauuccauaaaucaagaaaaguaauaguaguaguaucacaacacuucauacaaagcagauggugcauauucgaauacgaaauagcacaaacauggcaauucuuaagcucaagagcaggaauaauauuuauaguacuacaaaaaguagaaaaaacauuacuaagacaacaaguagaacuauauagauuacuaucaagaaauacauaucuagaaugggaagacucagucuuaggaagacacauauucuggcgaagacuaagaaaagcacuauuagacggaaaaucauggaauccagaaggaacaguaggaacaggaugcaacuggcaagaagcaacaucaauauga

SEQ ID NO: 76904 - RNA, 189 nt, Artificial Sequence; identical to SEQ ID NO: 76789
  O00206

SEQ ID NO: 76905 - RNA, 84 nt, Artificial Sequence; identical to SEQ ID NO: 76790
  P01730

SEQ ID NO: 76906 - RNA, 246 nt, Artificial Sequence
  P01850
guaaugucaguagcaacaauaguaauaguagacauaugcauaacaggaggacuacuacuacuaguauacuacuggucaaaaaacagaaaagcaaaagcaaaaccaguaacaagaggagcaggagcaggaggaagacaaagaggacaaaacaaagaaagaccaccaccaguaccaaacccagacuacgaaccaauaagaaaaggacaaagagaccuauacucaggacuaaaccaaagaagaauauga

SEQ ID NO: 76907 - RNA, 2190 nt, Artificial Sequence
  P07766
gcacuaauagcauuccuagcauuccuaauaauaguaacaagcauagcauuacuaguaguacuuuacaaaauauacgaccuacauaaaaaacgaagcuguaaccuagacgaacaacaagaauuaguugaaagagacgacgaaaaacaacuaaugaauguagaacccauacaugcagauauacucuuagaaaccuauaaaagaaaaauagccgaugaaggaagauuauuccuagcagaauuccaaaguauaccacgaguauucucaaaauucccaauuaaagaagcaagaaaaccauucaaccaaaacaaaaauagauauguggacauacuaccauacgacuacaacagaguagaauuaucagaaauuaauggcgacgcaggaagcaauuacauaaaugcaucauacauagacggcuucaaagaaccaagaaaauacauagcagcccaaggaccaagagacgaaacaguagaugacuuuuggaggaugauaugggaacaaaaagcaaccgugauagucaugguaacacguugugaagaaggaaauagaaauaaaugcgcugaauacuggcccucuauggaagaaggcacacgagccuucggagauguaguaguaaaaauaaaucaacauaaaagauguccggacuauaucauacaaaaauuaaacauaguaaauaaaaaagaaaaagcaaccggacgagaagucacacauauacaauucacaucauggcccgaccaugguguaccugaagacccucacuuauuauuaaaauugaggcgaagaguaaacgcauuuaguaauuucuucucaggaccaauaguaguacauugcagugccgguguugggcgcacagggacauacauagguaucgacgccaugcucgaaggacucgaagccgaaaacaaaguggacgucuauggcuauguagucaaauuacgaaggcaacgcugucuaaugguucaaguagaagcacaauacauacuuauacaucaggcauuaguagaauauaaccaauucggagaaacugaaguaaacuuaagugaacuacacccauauuuacauaacaugaaaaaacgagauccacccagcgaaccaucgccucuggaggcagaauuucaaagauuaccaucauauagaucuuggcgaacacaacacaucgguaaucaagaagaaaauaaaagcaaaaauagaaauucaaaugugaucccauaugacuacaaucgaguaccauuaaaacacgaacuagaaaugucuaaagaaagcgaacacgauucagaugaaagcagugaugacgacucagacagugaagaacccaguaaauacaucaacgccagcuuuauaauguccuauuggaaaccagaaguaaugauagccgcacaaggaccucuaaaagaaacaauuggagacuuuuggcagaugauauuucaaagaaaaguaaaagucauugugauguuaacugagcuaaaacacggagaccaagaaauaugugcacaauacuggggagaagggaaacaaacauauggugacauugaagucgacuuaaaagacacagacaaaagcucuacauauacacuacgaguuuucgaauuacgacauucaaaaaggaaagauucacgaacaguauaccaguaucaauacaccaauuggagcgucgaacaauuaccagcggaaccaaaagaacucauaucaaugauccaaguaguaaaacaaaaauuaccacaaaaaaacucauccgaaggaaacaaacaucacaaaucaaccccauuacucauacauuguagagacggaagucaacaaaccggaauuuucugcgcacucuuaaaccuacuagaaucagcugaaacagaagaaguaguagauauauuccaaguaguuaaagcucuccguaaagcaagaccaggaaugguaucaacauucgaacaauaccaauuucucuacgacguaauagcaucaacauacccagcacaaaacggacaaguaaaaaaaaauaaccaccaagaagauaaaauagaauuugauaacgaagucgacaagguaaagcaagacgccaauugcguaaauccccugggugcaccggaaaaacuaccagaagcaaaggaacaagcagaaggaagcgaaccaacaagcggcacagaaggaccugaacacagcguaaacggaccagccaguccagcacuaaaucaagguucauga

SEQ ID NO: 76908 - RNA, 141 nt, Artificial Sequence; identical to SEQ ID NO: 76793
  P08575

SEQ ID NO: 76909 - RNA, 207 nt, Artificial Sequence; identical to SEQ ID NO: 76794
  P08637

SEQ ID NO: 76910 - RNA, 252 nt, Artificial Sequence
  P10747
auaauaacagcagaaggaauaauacuacuauucugcgcaguaguaccaggaacacuacuacuauucagaaaaagauggcaaaacgaaaaacuaggacuagacgcaggagacgaauacgaagacgaaaaccuauacgaaggacuaaaccuagacgacugcucaauguacgaagacauaucaagaggacuacaaggaacauaccaagacguaggaucacuaaacauaggagacguacaacuagaaaaaccauga

SEQ ID NO: 76911 - RNA, 798 nt, Artificial Sequence
  P11912
guaagugcgguaacauuagcauaucuaauauuuuguuuauguagucuaguaggaauacuacacuuacaaagagcauuaguauuaagaagaaaaagaaaaagaaugacagauccuacaagaagauucuuuaaaguaacaccaccaccaggaucaggaccacaaaaucaauauggaaauguauuaucauugccaacaccaacaagcggauuagggagagcacaaagaugggcagcaggacuaggaggaacagcaccgagcuauggaaacccaucgucagauguacaagcagauggagcacuaggaaguagaagcccaccaggaguaggaccagaagaagaagaaggagaaggauaugaagaaccagauucagaagaagacagugaauuuuaugaaaacgauaguaauuuaggacaagaucaauugagucaagacggaaguggauaugaaaauccagaagaugaaccauuaggaccagaagaugaagauucauuuucaaaugcagaaucauaugaaaaugaagaugaagaacuaacccagccaguagcaagaacaauggacuuuuuaucaccacauggaucagcaugggauccaaguagagaagcaacaagccuaggaagucaaaguuaugaagauaugagaggaauauuauaugcagcaccacaauuaagaaguauaagaggacaaccaggaccaaaucaugaagaagaugcagauucauaugaaaauauggauaauccagauggaccagauccagcauggggaggaggaggaagaauggguacauggucaacaagauga

SEQ ID NO: 76912 - RNA, 189 nt, Artificial Sequence; identical to SEQ ID NO: 76797
  P15391

SEQ ID NO: 76913 - RNA, 219 nt, Artificial Sequence; identical to SEQ ID NO: 76798
  P16410

SEQ ID NO: 76914 - RNA, 192 nt, Artificial Sequence; identical to SEQ ID NO: 76799
  P16671

SEQ ID NO: 76915 - RNA, 213 nt, Artificial Sequence; identical to SEQ ID NO: 76800
  P26718

SEQ ID NO: 76916 - RNA, 249 nt, Artificial Sequence; identical to SEQ ID NO: 76801
  P30273

SEQ ID NO: 76917 - RNA, 249 nt, Artificial Sequence; identical to SEQ ID NO: 76802
  P32248

SEQ ID NO: 76918 - RNA, 303 nt, Artificial Sequence
  P40259
cuaguaggagcaggaguaguacuaaugcuaauaauacuaguagcacuacuaaugcuaguauucagaucaaaaagagaaguaaaaagacaaaaauacagacuaucacaacuauacaaauggcaagaagaagacucaggaccagcaccaggaacauuccaaaacauaggauucgacauaugccaagacgacgacucaauacaccuagaaucaauauacucaaacuuccaaccaucacuaagacacauagacccagaaacaaaaauaagaauacaaagaccacaaguaaugacaacaucauucuga

SEQ ID NO: 76919 - RNA, 177 nt, Artificial Sequence; identical to SEQ ID NO: 76804
  P42081

SEQ ID NO: 76920 - RNA, 645 nt, Artificial Sequence
  Q15762
gcaguaauacuauucuucuucacauucuucauaacaacaaugguaaugcucgcagcacuagcacaccaccuauucuacugggacguaugguucauauacaacguaugccuagcaaaaguaaaaggauacagaucauuaucaacaucacaaacauucuacgacgcauacauaucauacgacacaaaagacgcaucaguaacagacuggguaauaaacgaacuaagauaccaccuagaagaaucaagagacaaaaacguacuacuaugcuuagaagaaagagacugggacccaggacuagcaauaauagauaaccuaaugcaaucaauaaaccaaucaaaaaaaacagucuucguacuaacaaaaaaauacgcaaaaucauggaacuucaaaacagccuucuaccuagcacuacaaagacuaauggacgaaaauauggacguaauaauauucauauuauuagaacccguacuacaacacucacaauaccuaagacuaagacaaagaauaugcaaauccucaauauuacaauggccagacaacccaaaagcagaaggccuauucuggcaaacacuaagaaacguaguacuaacagaaaacgacucaagauacaacaacauguacguagacucaauaaaacaauacuga

SEQ ID NO: 76921 - RNA, 102 nt, Artificial Sequence; identical to SEQ ID NO: 76806
  Q685J3

SEQ ID NO: 76922 - RNA, 120 nt, Artificial Sequence
  Q9NNX6
gauagauauguagcuauaguucaagcuguaucugcacauagacauagagcuagaguucuauuaauaucuaaauuaagcuguguagguauauggauauuagcaacuguauuaagcauuuga

SEQ ID NO: 76923 - RNA, 129 nt, Artificial Sequence
  Q9NR97
agaacacuacuacaagcaagaaauuucgaaagaaacaaagcaauaaaaguaauaauagcaguaguaguaguauucauaguauuccaacuaccauacaacggaguaguacuagcacaaacaguagcauga

SEQ ID NO: 76924 - RNA, 105 nt, Artificial Sequence
  A0A5B9
acaauacuauacgaaauacuacuaggaaaagcaacacuauaugcaguacuaguaagcgcacuaguacuaauggcaaugguaaaaagaaaagacucaagaggauaa

SEQ ID NO: 76925 - RNA, 75 nt, Artificial Sequence
  B7Z8K6
cuaggccuacgcaugcucuuugccaaaacuguagccguaaauuuucuccuaacugcaaaauuauucuuccuuuga

SEQ ID NO: 76926 - RNA, 627 nt, Artificial Sequence
  B9A064
acaauaauaggaguaagcguacuauccguauuaguagugagcguaguagcaguauuaguauauaaauuuuacuuucacuuaauguuacuagcaggauguauaaaguacggaagaggagaaaacauauaugacgcauucguaauauauagcucacaagacgaagauuggguaagaaaugaauuagugaaaaacuuagaagaaggaguaccaccauuucaacuaugucuacauuacagagacuuuauacccggaguagcaauagcagcaaacauaauacaugaaggauuccauaaaagcagaaaaguaauaguaguaguaucacaacauuucauacaaucaagauggugcauauucgaauacgaaauagcacaaacauggcaauuuuuaagcucaagagcaggaauaauauuuauaguacuacaaaaaguagagaaaacauuacuaagacaacaaguagaacuauauagauuacuaaguagaaacacauaucuagaaugggaagacucaguauuaggaagacacauauucuggagaagauuaagaaaagcauuauuagacggaaaaucauggaauccagaaggaacaguaggaacaggaugcaauuggcaagaagcaacaucaauauga

SEQ ID NO: 76927 - RNA, 189 nt, Artificial Sequence; identical to SEQ ID NO: 76789
  O00206

SEQ ID NO: 76928 - RNA, 84 nt, Artificial Sequence
  P01730
auacuucuagguaaagcuacacuuuacgcuguacuuguaucugcacuuguacuuauggcuaugguuaaacguaaagauuucuga

SEQ ID NO: 76929 - RNA, 246 nt, Artificial Sequence; identical to SEQ ID NO: 76791
  P01850

SEQ ID NO: 76930 - RNA, 2190 nt, Artificial Sequence
  P07766
gcccuaauugcauuucuagcauuucugauaauuguaacauccaucgcacuauuaguaguauuauacaaaauauacgacuuacacaaaaaaagaaguugcaacuuagacgagcaacaggaguuaguagaaagagaugacgaaaaacaacuuaugaacguugaaccaauacaugcugacaucuuacuagaaacguacaaaaggaaaauagcagaugaaggacgauuauuccuagcagaauuccaaucaauacccagaguauucucuaaauucccaauaaaagaagcaagaaagccuuuuaaucaaaacaaaaauagauauguugacauacucccauacgacuacaacagaguagaauuaucugagaucaauggcgaugcaggauccaauuacauaaaugcaucauauauagauggauuuaaagaaccucgaaaauacauagcagcacaaggcccacgagacgaaacgguagaugacuucuggagaaugaucugggaacaaaaagcaacaguaauaguaaugguaacacgaugcgaagaaggcaaucgaaacaaaugugcagaauacuggccaucuauggaagaaggaacacgcgcauucggagacgucguaguaaaaauaaaucaacauaaaagaugucccgacuacauaauacaaaaacuaaacauaguuaauaaaaaagaaaaagccacuggaagagaagucacacauauacaauucacaucguggccagaucacggaguaccagaagauccccaccuacuacuaaaacuaagaagaagaguaaaugcauucucuaacuuuuucagcggaccaauaguuguacacugcuccgcaggaguaggcagaaccggcacauacauaggcauugacgcuaugcucgaaggccuagaagcagaaaacaaaguugauguguacggauauguaguaaaacuaagacggcaaagaugccuaaugguacaaguagaggcacaauacauucuaauacaucaggcacuaguagaauauaaucaauuuggagaaacggaaguaaaccuauccgaacuacacccuuacuuacacaauaugaaaaaaagagacccaccaucagaacccucaccccuagaggcagaauuccaacgucuaccgucauauagaagcuggagaacucaacauauaggaaaucaagaagagaacaaaucaaaaaaccgcaauaguaacguaauaccuuaugacuacaacagaguaccacuaaaacacgaauuagaaaugaguaaagaauccgaacacgacucagaugaaaguucagaugaugacagcgacucagaagaaccauccaaauacauaaaugcauccuuuaucauguccuacuggaaaccagaaguaaugauagcagcacaaggaccacuuaaagaaacaauaggagauuuuuggcaaaugauauuccaaaggaaaguuaaaguuaucgucaugcuuacagaacuuaaacacggagaucaagaaaucugugcccaauauuggggagaagguaagcaaacuuacggagacauagaaguagaucucaaagacacagacaaaucaucaacauacacuuuacgaguauuugaacuaaggcauucaaaaagaaaagacucaaggacaguguaccaauaucaguacaccaacuggucaguagaacaacuaccagcugaaccaaaagaacuaaucagcaugauucaaguuguaaaacaaaaacuaccacaaaaaaauucaucugaagguaacaaacaucacaaaucaacuccacuucuaauacacugcagagauggaucucaacaaacaggcauauuuugugcacuccuaaacuuacuagaaucagcagaaacggaagaaguuguagacauauuucaaguaguaaaagcacuaagaaaagcaagaccuggaaugguaaguacauucgaacaauaccaauucuuauacgaugucaucgccucaacauacccagcucaaaauggacaagucaaaaaaaacaaccaccaagaagauaaaauagaauucgacaacgaagucgacaaaguaaaacaagacgcuaacugcguaaacccuuuaggagcaccagaaaaauuaccagaagcaaaggagcaggcagaagggucugagcccacaucaggaacagaaggaccugaacacaguguaaauggaccagcaucuccagcauuaaaccaaggaucauga

SEQ ID NO: 76931 - RNA, 141 nt, Artificial Sequence; identical to SEQ ID NO: 76793
  P08575

SEQ ID NO: 76932 - RNA, 207 nt, Artificial Sequence; identical to SEQ ID NO: 76794
  P08637

SEQ ID NO: 76933 - RNA, 252 nt, Artificial Sequence
  P10747
auaauaacagcagaaggaauaauauuacuauucugcgcaguaguaccaggaacauuacuauuauucagaaaaagauggcaaaacgaaaaauuaggacuagacgcaggagacgaauaugaagacgaaaaucuauaugaaggacuaaaucuagaugacuguagcauguacgaagacauaagcagaggacuacaaggaacauaucaagacguaggaagccuaaacauaggagacguacaacuagaaaaaccauga

SEQ ID NO: 76934 - RNA, 798 nt, Artificial Sequence
  P11912
guaagugcaguaacauuggcauauuuaauauuuuguuuauguucacuaguaggaauauuacauuuacaaagagcauuaguauuaagaagaaaaagaaaaagaaugacugauccaacaagaagauuuuuuaaaguaacaccaccaccaggaucaggaccacaaaaucaauauggaaauguauuaaguuuaccuacaccaacaaguggauuagggagagcacaaagaugggcagcaggauuaggaggaacagcaccaagcuauggaaauccaucaagcgauguacaagcagauggagcauuagguaguagaaguccaccaggaguaggacccgaagaagaagaaggagaaggauaugaagaaccagauucagaagaagauagcgaauuuuaugaaaaugauucaaaucuaggacaagaucaauuaagucaagauggaaguggauacgaaaauccagaagaugaaccauuaggaccagaagacgaagauaguuuuucaaaugcagaaucauaugaaaaugaagacgaagaauugacacaaccuguagcaagaacaauggauuuuuuaaguccacauggaagugcuugggauccaagcagagaagcaacaucauuaggaagucaaaguuaugaagauaugagaggaauauuauaugcagcaccacaauuaagaaguauaagaggacaaccaggaccaaaucaugaagaagaugcagauaguuaugaaaauauggauaauccagauggaccagauccagcauggggaggaggaggaagaaugggaacauggucaacuagauga

SEQ ID NO: 76935 - RNA, 189 nt, Artificial Sequence; identical to SEQ ID NO: 76797
  P15391

SEQ ID NO: 76936 - RNA, 219 nt, Artificial Sequence; identical to SEQ ID NO: 76798
  P16410

SEQ ID NO: 76937 - RNA, 192 nt, Artificial Sequence; identical to SEQ ID NO: 76799
  P16671

SEQ ID NO: 76938 - RNA, 213 nt, Artificial Sequence; identical to SEQ ID NO: 76800
  P26718

SEQ ID NO: 76939 - RNA, 249 nt, Artificial Sequence; identical to SEQ ID NO: 76801
  P30273

SEQ ID NO: 76940 - RNA, 249 nt, Artificial Sequence; identical to SEQ ID NO: 76802
  P32248

SEQ ID NO: 76941 - RNA, 303 nt, Artificial Sequence; identical to SEQ ID NO: 76918
  P40259

SEQ ID NO: 76942 - RNA, 177 nt, Artificial Sequence; identical to SEQ ID NO: 76804
  P42081

SEQ ID NO: 76943 - RNA, 645 nt, Artificial Sequence
  Q15762
gcaguaauacuauucuucuucacauucuucauaacaacaauggucauguuagcagcacuagcacaccaccuauuuuauugggacguaugguucauauacaacguaugccuagcaaaaguaaaaggauacagaucacuaucaacaucacaaacauucuacgacgccuacauaucauacgacacaaaagacgccucaguaacagacuggguaauaaacgaauuaagauaccacuuagaagaaucacgagacaaaaacguacuauuaugccuagaagaaagagacugggacccaggacuagcaauaauagacaaccuaaugcaaucaaucaaccaauccaaaaaaacuguauucguacuaacaaaaaaauacgcaaaaucauggaacuucaaaacagccuucuacuuagcauuacaaagacuaauggacgaaaacauggacguaauaauauucaucuuacuagaaccaguacuccaacacucacaauaccuaagacuacgacaaagaauaugcaaaucaucaauacuacaauggccagacaacccaaaagcagaaggacuauucuggcaaacacuuagaaacguaguacuaacagaaaacgacucaagauacaacaacauguacguagacucaauaaaacaauauuga

SEQ ID NO: 76944 - RNA, 102 nt, Artificial Sequence; identical to SEQ ID NO: 76806
  Q685J3

SEQ ID NO: 76945 - RNA, 120 nt, Artificial Sequence; identical to SEQ ID NO: 76807
  Q9NNX6

SEQ ID NO: 76946 - RNA, 129 nt, Artificial Sequence
  Q9NR97
agaacacuauuacaagcaagaaauuucgaaagaaauaaagcaauaaaaguaauaauagcaguaguaguaguauucauaguauuucaauugccauauaacggaguaguacuagcacaaacaguagcauga

SEQ ID NO: 76947 - RNA, 189 nt, Artificial Sequence
  P16410
uuuuuguuguggauauuggccgccgucucgagcggccucuucuucuacucguucuuguugaccgccgucagccucucgaagauguugaaaaagcgcucgccguugaccaccggcguguacgucaagaugccgccgaccgaaccggagugcgagaaacaguuccaaccguacuucaucccgauaaacuga

SEQ ID NO: 76948 - protein, 24 aa, Artificial Sequence
  P30443_1-18
MAVMAPRTLLLLLSGALALTQTWA

SEQ ID NO: 76949 - protein, 18 aa, Artificial Sequence
  Q6GPI1_1-18
MAFLWLLSCWALLGTTFG

SEQ ID NO: 76950 - protein, 18 aa, Artificial Sequence
  P02768_1-18
MKWVTFISLLFLFSSAYS

SEQ ID NO: 76951 - protein, 18 aa, Artificial Sequence
  AAB59424.1_1-18
MDWTWILFLVAAATRVHS

SEQ ID NO: 76952 - RNA, 72 nt, Artificial Sequence
  P30443_1-54
auggccgucauggcgccccgaacccuccuccugcuacucucgggggcccuggcccugacccagaccugggcg

SEQ ID NO: 76953 - RNA, 54 nt, Artificial Sequence
  Q6GPI1_1-54
auggcuuuccucuggcuccucuccugcugggcccuccuggguaccaccuucggc

SEQ ID NO: 76954 - RNA, 54 nt, Artificial Sequence
  P02768_1-54
augaaguggguaaccuuuauuucccuucuuuuucucuuuagcucggcuuauucc

SEQ ID NO: 76955 - RNA, 54 nt, Artificial Sequence
  AAB59424.1_1-54
auggacuggaccuggauccucuucuugguggcagcagccacgcgaguccacucc

SEQ ID NO: 76956 - RNA, 72 nt, Artificial Sequence
  P30443_1-54
auggccgugauggcgccccgcacccugcuccugcugcucagcggcgcccuggcccugacccagacgugggcc

SEQ ID NO: 76957 - RNA, 54 nt, Artificial Sequence
  Q6GPI1_1-54
auggccuuccuguggcuccugagcugcugggcccugcucggcaccaccuucggg

SEQ ID NO: 76958 - RNA, 54 nt, Artificial Sequence
  P02768_1-54
augaagugggugaccuucaucagccuccuguuccuguucuccagcgccuacucc

SEQ ID NO: 76959 - RNA, 54 nt, Artificial Sequence
  AAB59424.1_1-54
auggacuggaccuggauccuguuccucguggccgccgcgacccgcguccacagc

SEQ ID NO: 76960 - RNA, 72 nt, Artificial Sequence
  P30443_1-54
auggccgucauggccccccgcacccuccuccuccuccucuccggcgcccucgcccucacccagaccugggcc

SEQ ID NO: 76961 - RNA, 54 nt, Artificial Sequence
  Q6GPI1_1-54
auggccuuccucuggcuccucuccugcugggcccuccucggcaccaccuucggc

SEQ ID NO: 76962 - RNA, 54 nt, Artificial Sequence
  P02768_1-54
augaagugggucaccuucaucucccuccucuuccucuucuccuccgccuacucc

SEQ ID NO: 76963 - RNA, 54 nt, Artificial Sequence
  AAB59424.1_1-54
auggacuggaccuggauccucuuccucgucgccgccgccacccgcguccacucc

SEQ ID NO: 76964 - RNA, 72 nt, Artificial Sequence
  P30443_1-54
auggccgugauggcucccagaacccugcuccuucuguugagcggcgcauuagcccugacacagacuugggcg

SEQ ID NO: 76965 - RNA, 54 nt, Artificial Sequence
  Q6GPI1_1-54
auggccuuccuguggcuccuuagcugcugggcucuguugggcaccacauuuggg

SEQ ID NO: 76966 - RNA, 54 nt, Artificial Sequence
  P02768_1-54
augaagugggugaccuucaucagccugcucuuucuuuucuccucugccuacuca

SEQ ID NO: 76967 - RNA, 54 nt, Artificial Sequence
  AAB59424.1_1-54
auggacuggaccuggauccuguuccucguggccgcugcaacaagaguccacagc

SEQ ID NO: 76968 - RNA, 72 nt, Artificial Sequence
  P30443_1-54
auggccgugauggcccccagaacccugcugcugcugcugagcggcgcccuggcccugacccagaccugggcc

SEQ ID NO: 76969 - RNA, 54 nt, Artificial Sequence
  Q6GPI1_1-54
auggccuuccuguggcugcugagcugcugggcccugcugggcaccaccuucggc

SEQ ID NO: 76970 - RNA, 54 nt, Artificial Sequence
  P02768_1-54
augaagugggugaccuucaucagccugcuguuccuguucagcagcgccuacagc

SEQ ID NO: 76971 - RNA, 54 nt, Artificial Sequence
  AAB59424.1_1-54
auggacuggaccuggauccuguuccugguggccgccgccaccagagugcacagc

SEQ ID NO: 76972 - RNA, 72 nt, Artificial Sequence
  P30443_1-54
auggccgugauggcucccagaacccugcuccugcuucugagcggcgcccucgcgcugacacagacgugggcu

SEQ ID NO: 76973 - RNA, 54 nt, Artificial Sequence
  Q6GPI1_1-54
auggcuuuccuguggcuccugagcugcugggcccuucugggcaccacauuuggg

SEQ ID NO: 76974 - RNA, 54 nt, Artificial Sequence
  P02768_1-54
augaagugggugaccuucaucagccugcucuuucuguucuccucugccuacagc

SEQ ID NO: 76975 - RNA, 54 nt, Artificial Sequence
  AAB59424.1_1-54
auggacuggaccuggauccuguuccucguggccgcugccacaagaguccacagc

SEQ ID NO: 76976 - RNA, 72 nt, Artificial Sequence
  P30443_1-54
auggcaguaauggcaccaagaacacuauuacuauuacuaucaggagcacuagcacuaacacaaacaugggca

SEQ ID NO: 76977 - RNA, 54 nt, Artificial Sequence
  Q6GPI1_1-54
auggcauuuuuaugguuauuaucauguugggcuuuauuaggaacuacauuugga

SEQ ID NO: 76978 - RNA, 54 nt, Artificial Sequence
  P02768_1-54
augaaauggguuacuuuuauuucucuucuuuuucuuuuuucuucugcuuacucu

SEQ ID NO: 76979 - RNA, 54 nt, Artificial Sequence
  AAB59424.1_1-54
auggacuggacauggauauuauuuuuaguagcagcagcaacaagaguacauuca

SEQ ID NO: 76980 - RNA, 72 nt, Artificial Sequence
  P30443_1-54
auggccgugauggcacccaggacccugcuccuguugcugagcggcgcccucgcgcugacucagaccugggcc

SEQ ID NO: 76981 - RNA, 54 nt, Artificial Sequence
  Q6GPI1_1-54
auggccuuccuguggcuccugagcugcugggcauugcugggcaccacuuuuggg

SEQ ID NO: 76982 - RNA, 54 nt, Artificial Sequence
  P02768_1-54
augaagugggugaccuucaucagccugcucuuucuguucuccagugccuacagc

SEQ ID NO: 76983 - RNA, 54 nt, Artificial Sequence
  AAB59424.1_1-54
auggacuggaccuggauccuguuccucguggccgcagccacuaggguccacagc

SEQ ID NO: 76984 - RNA, 72 nt, Artificial Sequence
  P30443_1-54
auggcggucauggccccgcgcacgcucuugcucuugcucucgggcgcacuagcgcuaacgcaaacgugggcg

SEQ ID NO: 76985 - RNA, 54 nt, Artificial Sequence
  Q6GPI1_1-54
auggccuuccucuggcuccuuuccugcugggcccuccuuggcacuacuuucggc

SEQ ID NO: 76986 - RNA, 54 nt, Artificial Sequence
  P02768_1-54
augaaaugggucaccuucaucucccuccucuuccucuucuccucugccuacucc

SEQ ID NO: 76987 - RNA, 54 nt, Artificial Sequence
  AAB59424.1_1-54
auggacuggaccuggauacucuuccucgucgcugccgcuacccgcguccacuca

SEQ ID NO: 76988 - RNA, 72 nt, Artificial Sequence
  P30443_1-54
auggcggucauggccccgcgcacgcucuugcuauugcucucgggcgcgcucgcgcucacgcaaacgugggcg

SEQ ID NO: 76989 - RNA, 54 nt, Artificial Sequence
  Q6GPI1_1-54
auggcguucuugugguugcucucgugcugggccuugcuugggaccacguucggg

SEQ ID NO: 76990 - RNA, 54 nt, Artificial Sequence
  P02768_1-54
augaaaugggucacuuucaucucccuccucuuccucuucuccuccgccuacucc

SEQ ID NO: 76991 - RNA, 54 nt, Artificial Sequence
  AAB59424.1_1-54
auggauuggacguggauacucuuucucguggccgcggccacgcgcgugcacucg

SEQ ID NO: 76992 - RNA, 72 nt, Artificial Sequence
  P30443_1-54
auggccgucauggccccccgcacccuccuccuccuccucuccggcgcccucgcccucacccaaaccugggcc

SEQ ID NO: 76993 - RNA, 54 nt, Artificial Sequence; identical to SEQ ID NO: 76961
  Q6GPI1_1-54

SEQ ID NO: 76994 - RNA, 54 nt, Artificial Sequence
  P02768_1-54
augaaaugggucaccuucaucucccuccucuuccucuucuccuccgccuacucc

SEQ ID NO: 76995 - RNA, 54 nt, Artificial Sequence
  AAB59424.1_1-54
auggacuggaccuggauacucuuccucgucgccgccgccacccgcguccacuca

SEQ ID NO: 76996 - RNA, 72 nt, Artificial Sequence; identical to SEQ ID NO: 76976
  P30443_1-54

SEQ ID NO: 76997 - RNA, 54 nt, Artificial Sequence
  Q6GPI1_1-54
auggcuuuuuuaugguuauuaucuuguugggcuuuauuagguacuacuuuuggu

SEQ ID NO: 76998 - RNA, 54 nt, Artificial Sequence; identical to SEQ ID NO: 76978
  P02768_1-54

SEQ ID NO: 76999 - RNA, 54 nt, Artificial Sequence; identical to SEQ ID NO: 76979
  AAB59424.1_1-54

SEQ ID NO: 77000 - RNA, 72 nt, Artificial Sequence; identical to SEQ ID NO: 76976
  P30443_1-54

SEQ ID NO: 77001 - RNA, 54 nt, Artificial Sequence; identical to SEQ ID NO: 76977
  Q6GPI1_1-54

SEQ ID NO: 77002 - RNA, 54 nt, Artificial Sequence; identical to SEQ ID NO: 76978
  P02768_1-54

SEQ ID NO: 77003 - RNA, 54 nt, Artificial Sequence; identical to SEQ ID NO: 76979
  AAB59424.1_1-54

SEQ ID NO: 77004 - RNA, 189 nt, Artificial Sequence
  HsCTLA4(162-223)1
uuccugcuguggauccuggccgccguguccuccggccucuucuucuacuccuuccuccucacggcggugagccugagcaagaugcugaagaagcgcagcccccugaccaccgggguguacgucaagaugccgcccaccgagcccgagugcgagaagcaguuccagcccuacuucaucccgaucaacuga

SEQ ID NO: 77005 - RNA, 189 nt, Artificial Sequence
  HsCTLA4(162-223)2
uuccuccuguggauccucgccgccgugagcagcgggcuguucuucuacagcuuccugcugaccgcggucucccuguccaagaugcucaagaagcgcuccccccugaccaccggcguguacgugaagaugccgcccacggagcccgagugcgagaagcaguuccagcccuacuucaucccgaucaacuga

SEQ ID NO: 77006 - RNA, 189 nt, Artificial Sequence
  HsCTLA4(162-223)3
uuccuccuguggauccuggccgccgucuccuccgggcuguucuucuacuccuuccuccucacggcggugagccugagcaagaugcugaagaagcgcagcccccugaccaccggcguguacgugaagaugccgcccaccgagccggagugcgagaagcaguuccagcccuacuucauccccaucaacuga

SEQ ID NO: 77007 - RNA, 189 nt, Artificial Sequence
  HsCTLA4(162-223)4
uuccuccucuggauccucgccgcgguguccuccgggcuguucuucuacagcuuccugcugaccgccgucagccuguccaagaugcugaagaagcgcagcccccugacgaccggcguguacgugaagaugccccccaccgagccggagugcgagaagcaguuccagcccuacuucaucccgaucaacuga

SEQ ID NO: 77008 - RNA, 189 nt, Artificial Sequence
  HsCTLA4(162-223)5
uuccuccucuggauccucgccgccguguccuccgggcuguucuucuacagcuuccugcugaccgcggucagccuguccaagaugcugaagaagcgcagcccccugacgaccggcguguacgugaagaugccccccaccgagccggagugcgagaagcaguuccagcccuacuucaucccgaucaacuga

SEQ ID NO: 77009 - RNA, 189 nt, Artificial Sequence
  HsCTLA4(162-223)6
uuccuccuguggauccucgccgccgugagcagcgggcuguucuucuacagcuuccugcugaccgcggucucccucuccaagaugcugaagaagcgcuccccccugaccaccggcguguacgugaagaugccgcccacggagcccgagugcgagaagcaguuccagcccuacuucaucccgaucaacuga

SEQ ID NO: 77010 - RNA, 189 nt, Artificial Sequence
  HsCTLA4(162-223)7
uuccuccuguggauccucgccgccgucuccuccggccucuucuucuacagcuuccugcugaccgcggugagccugagcaagaugcugaagaagcgcuccccccugaccaccgggguguacgugaagaugccgcccacggagcccgagugcgagaagcaguuccagcccuacuucaucccgaucaacuga

SEQ ID NO: 77011 - RNA, 189 nt, Artificial Sequence
  HsCTLA4(162-223)8
uuccugcuguggauccuggccgccgucagcagcgggcucuucuucuacuccuuccuccucacggcggugucccugagcaagaugcugaagaagcgcuccccccugaccaccggcguguacgugaagaugccgcccaccgagcccgagugcgagaagcaguuccagcccuacuucaucccgaucaacuga

SEQ ID NO: 77012 - RNA, 189 nt, Artificial Sequence
  HsCTLA4(162-223)9
uuccuccuguggauccucgccgcggugagcuccgggcuguucuucuacagcuuccugcugaccgccgugagccuguccaagaugcucaagaagcgcuccccccugaccaccggcgucuacgugaagaugccgcccacggagcccgagugcgagaagcaguuccagcccuacuucaucccgaucaacuga

SEQ ID NO: 77013 - RNA, 189 nt, Artificial Sequence
  HsCTLA4(162-223)10
uuccuccuguggauccuggccgccgugagcagcgggcuguucuucuacagcuuccugcugaccgcggucucccucuccaagaugcucaagaagcgcuccccccugaccaccggcguguacgugaagaugccgcccacggagcccgagugcgagaagcaguuccagcccuacuucaucccgaucaacuga

SEQ ID NO: 77014 - RNA, 189 nt, Artificial Sequence
  HsCTLA4(162-223)11
uuccuccucuggauccuggccgcggugagcuccgggcuguucuucuacagcuuccugcugaccgccgugagccucuccaagaugcugaagaagcgcuccccccugaccaccggcgucuacgugaagaugccgcccacggagcccgagugcgagaagcaguuccagcccuacuucaucccgaucaacuga

SEQ ID NO: 77015 - RNA, 189 nt, Artificial Sequence
  HsCTLA4(162-223)12
uuccuccuguggauccucgccgcggugagcuccgggcuguucuucuacagcuuccugcugaccgccgucucccucagcaagaugcugaagaagcgcuccccccugaccaccggcguguacgugaagaugccgcccacggagcccgagugcgagaagcaguuccagcccuacuucaucccgaucaacuga

SEQ ID NO: 77016 - RNA, 189 nt, Artificial Sequence
  HsCTLA4(162-223)13
uuccuccucuggauccucgccgccgucuccuccgggcuguucuucuacagcuuccugcugaccgcggugagccugagcaagaugcugaagaagcgcuccccccugaccaccggcguguacgugaagaugccccccacggagcccgagugcgagaagcaguuccagccguacuucaucccgaucaacuga

SEQ ID NO: 77017 - RNA, 189 nt, Artificial Sequence
  HsCTLA4(162-223)14
uuccuccuguggauccuggccgccgucuccuccgggcucuucuucuacuccuuccuccugaccgcggugagccugagcaagaugcugaagaagcgcagcccccugaccaccggcguguacgugaagaugccccccacggagccggagugcgagaagcaguuccagcccuacuucaucccgaucaacuga

SEQ ID NO: 77018 - protein, 1 aa, Artificial Sequence
  Linker 20
G

SEQ ID NO: 77019 - protein, 2 aa, Artificial Sequence
  Linker 21
SG

SEQ ID NO: 77020 - protein, 3 aa, Artificial Sequence
  Linker 22
GGS

SEQ ID NO: 77021 - protein, 3 aa, Artificial Sequence
  Linker 23
GSG

SEQ ID NO: 77022 - protein, 3 aa, Artificial Sequence
  Linker 24
SGG

SEQ ID NO: 77023 - protein, 3 aa, Artificial Sequence
  Linker 25
GGG

SEQ ID NO: 77024 - protein, 4 aa, Artificial Sequence
  Linker 26
GGGS

SEQ ID NO: 77025 - protein, 4 aa, Artificial Sequence
  Linker 27
SGGG

SEQ ID NO: 77026 - protein, 7 aa, Artificial Sequence
  Linker 28
GGGGSGS

SEQ ID NO: 77027 - protein, 8 aa, Artificial Sequence
  Linker 29
GGGGSGGS

SEQ ID NO: 77028 - protein, 10 aa, Artificial Sequence
  Linker 30
GGGGSGGGGS

SEQ ID NO: 77029 - protein, 15 aa, Artificial Sequence
  Linker 31
GGGGSGGGGSGGGGS

SEQ ID NO: 77030 - protein, 16 aa, Artificial Sequence
  Linker 32
AKTTPKLEEGEFSEAR

SEQ ID NO: 77031 - protein, 17 aa, Artificial Sequence
  Linker 33
AKTTPKLEEGEFSEARV

SEQ ID NO: 77032 - protein, 9 aa, Artificial Sequence
  Linker 34
AKTTPKLGG

SEQ ID NO: 77033 - protein, 10 aa, Artificial Sequence
  Linker 35
SAKTTPKLGG

SEQ ID NO: 77034 - protein, 17 aa, Artificial Sequence
  Linker 36
AKTTPKLEEGEFSEARV

SEQ ID NO: 77035 - protein, 6 aa, Artificial Sequence
  Linker 37
SAKTTP

SEQ ID NO: 77036 - protein, 10 aa, Artificial Sequence
  Linker 38
SAKTTPKLGG

SEQ ID NO: 77037 - protein, 6 aa, Artificial Sequence
  Linker 39
RADAAP

SEQ ID NO: 77038 - protein, 9 aa, Artificial Sequence
  Linker 40
RADAAPTVS

SEQ ID NO: 77039 - protein, 12 aa, Artificial Sequence
  Linker 41
RADAAAAGGPGS

SEQ ID NO: 77040 - protein, 27 aa, Artificial Sequence
  Linker 42
RADAAAAGGGGSGGGGSGGGGSGGGGS

SEQ ID NO: 77041 - protein, 6 aa, Artificial Sequence
  Linker 43
SAKTTP

SEQ ID NO: 77042 - protein, 10 aa, Artificial Sequence
  Linker 44
SAKTTPKLGG

SEQ ID NO: 77043 - protein, 18 aa, Artificial Sequence
  Linker 45
SAKTTPKLEEGEFSEARV

SEQ ID NO: 77044 - protein, 5 aa, Artificial Sequence
  Linker 46
ADAAP

SEQ ID NO: 77045 - protein, 12 aa, Artificial Sequence
  Linker 47
ADAAPTVSIFPP

SEQ ID NO: 77046 - protein, 5 aa, Artificial Sequence
  Linker 48
TVAAP

SEQ ID NO: 77047 - protein, 12 aa, Artificial Sequence
  Linker 49
TVAAPSVFIFPP

SEQ ID NO: 77048 - protein, 6 aa, Artificial Sequence
  Linker 50
QPKAAP

SEQ ID NO: 77049 - protein, 13 aa, Artificial Sequence
  Linker 51
QPKAAPSVTLFPP

SEQ ID NO: 77050 - protein, 6 aa, Artificial Sequence
  Linker 52
AKTTPP

SEQ ID NO: 77051 - protein, 13 aa, Artificial Sequence
  Linker 53
AKTTPPSVTPLAP

SEQ ID NO: 77052 - protein, 6 aa, Artificial Sequence
  Linker 54
AKTTAP

SEQ ID NO: 77053 - protein, 13 aa, Artificial Sequence
  Linker 55
AKTTAPSVYPLAP

SEQ ID NO: 77054 - protein, 6 aa, Artificial Sequence
  Linker 56
ASTKGP

SEQ ID NO: 77055 - protein, 13 aa, Artificial Sequence
  Linker 57
ASTKGPSVFPLAP

SEQ ID NO: 77056 - protein, 15 aa, Artificial Sequence
  Linker 58
GENKVEYAPALMALS

SEQ ID NO: 77057 - protein, 15 aa, Artificial Sequence
  Linker 59
GPAKELTPLKEAKVS

SEQ ID NO: 77058 - protein, 15 aa, Artificial Sequence
  Linker 60
GHEAAAVMQVQYPAS

SEQ ID NO: 77059 - RNA, 45 nt, Artificial Sequence
  CV Linker (G4S)3(GA1)
ggcggaggcggaucugguggcggaggaagugguggcggcggaucu

SEQ ID NO: 77060 - RNA, 45 nt, Artificial Sequence
  CV Linker (G4S)3(GA2)
ggcggcggaggaucaggcggugguggaagcggaggugguggaucu

SEQ ID NO: 77061 - RNA, 45 nt, Artificial Sequence
  CV Linker (G4S)3(GA3)
ggugguggugguucaggcggcggugguucuggcgguggcggcucu

SEQ ID NO: 77062 - RNA, 560 nt, Artificial Sequence
  HsCTLA4(1-35)(GC)_Linker-(GGGGS)3-V2(GC)_GgOva(249-273)(GC)_Linke r-(GGGGS)3-V3(GC)_PADRE(GC)_Linker-(GGGGS)3(GC)_HsCTLA4(162-223)( GC)
aagcuuaccauggccugccugggcuuccagcgccacaaggcccagcucaaccuggcgacccggaccuggcccugcacgcugcucuucuuccugcuguucauccccguguucugcgggggcgggggcagcgggggcggcggguccggcgggggcgggagcgaggucagcggccucgagcagcuggagucgaucaucaacuucgagaagcugaccgaguggaccagcagcaacgugggcgggggcggguccggcggcgggggcagcgggggcgggggcuccgccaaguucguggccgccuggacccugaaggcggccgccggcgggggcgggagcggcgggggcggcuccgggggcgggggcagcuuccuccuguggauccuggccgccgucuccagcggccucuucuucuacuccuuccugcugaccgcggugagccucuccaagaugcugaagaagcgcagcccccugacgaccgggguguacgucaagaugccgcccaccgagcccgagugcgagaagcaguuccagcccuacuucauccccaucaacugaggacuagu

SEQ ID NO: 77063 - protein, 180 aa, Artificial Sequence
  HsCTLA4(1-35)(GC)_Linker-(GGGGS)3-V2(GC)_GgOva(249-273)(GC)_Linke r-(GGGGS)3-V3(GC)_PADRE(GC)_Linker-(GGGGS)3(GC)_HsCTLA4(162-223)( GC)
MACLGFQRHKAQLNLATRTWPCTLLFFLLFIPVFCGGGGSGGGGSGGGGSEVSGLEQLESIINFEKLTEWTSSNVGGGGSGGGGSGGGGSAKFVAAWTLKAAAGGGGSGGGGSGGGGSFLLWILAAVSSGLFFYSFLLTAVSLSKMLKKRSPLTTGVYVKMPPTEPECEKQFQPYFIPIN

SEQ ID NO: 77064 - RNA, 75 nt, Artificial Sequence
  Ova epitope (249-273)
gaggucagcggccucgagcagcuggagucgaucaucaacuucgagaagcugaccgaguggaccagcagcaacgug

SEQ ID NO: 77065 - protein, 25 aa, Artificial Sequence
  Ova epitope (249-273)
EVSGLEQLESIINFEKLTEWTSSNV

SEQ ID NO: 77066 - RNA, 189 nt, Artificial Sequence
  HsCTLA4(162-223)opt1
uuccugcucuggauccuggccgccgugagcuccggccuguucuucuacagcuuccuccugaccgcggucucccugagcaagaugcucaagaagcgcuccccccugaccacggggguguacgugaagaugccgcccaccgagcccgagugcgagaagcaguuccagcccuacuucaucccgaucaacuga
